United States Patent
Chappel et al.

(10) Patent No.: US 11,655,303 B2
(45) Date of Patent: *May 23, 2023

(54) ANTI-CD39 ANTIBODY COMPOSITIONS AND METHODS

(71) Applicant: Surface Oncology, Inc., Cambridge, MA (US)

(72) Inventors: Scott Chappel, Milton, MA (US); Andrew Lake, Westwood, MA (US); Michael Warren, North Chelmsford, MA (US); Austin Dulak, Reading, MA (US); Erik Devereaux, Hanover, MA (US); Pamela M. Holland, Belmont, MA (US); Tauqeer Zaidi, Sharon, MA (US); Matthew Rausch, Cambridge, MA (US); Bianka Prinz, Lebanon, NH (US); Nels P. Nielson, Lebanon, NH (US); Sonia Das, Cambridge, MA (US); Alison M. O'Neill, Cambridge, MA (US)

(73) Assignee: Surface Oncology, Inc., Cambridge, MA (US)

( * ) Notice: Subject to any disclaimer, the term of this patent is extended or adjusted under 35 U.S.C. 154(b) by 394 days.

This patent is subject to a terminal disclaimer.

(21) Appl. No.: 17/021,223

(22) Filed: Sep. 15, 2020

(65) Prior Publication Data

US 2021/0095041 A1 Apr. 1, 2021

Related U.S. Application Data

(60) Provisional application No. 63/075,567, filed on Sep. 8, 2020, provisional application No. 63/003,191, filed on Mar. 31, 2020, provisional application No. 62/975,519, filed on Feb. 12, 2020, provisional application No. 62/935,969, filed on Nov. 15, 2019, provisional application No. 62/932,249, filed on Nov. 7, 2019, provisional application No. 62/902,285, filed on Sep. 18, 2019, provisional application No. 62/901,153, filed on Sep. 16, 2019.

(51) Int. Cl.
| | |
|---|---|
| *C07K 16/28* | (2006.01) |
| *A61P 35/00* | (2006.01) |
| *A61K 45/06* | (2006.01) |
| *A61K 39/395* | (2006.01) |
| *A61K 31/337* | (2006.01) |
| *A61K 31/7068* | (2006.01) |
| *A61K 39/00* | (2006.01) |

(52) U.S. Cl.
CPC ........ *C07K 16/2896* (2013.01); *A61K 31/337* (2013.01); *A61K 31/7068* (2013.01); *A61K 39/39541* (2013.01); *A61K 39/39558* (2013.01); *A61K 45/06* (2013.01); *A61P 35/00* (2018.01); *C07K 16/2803* (2013.01); *C07K 16/2818* (2013.01); *A61K 2039/505* (2013.01); *A61K 2039/507* (2013.01); *C07K 2317/24* (2013.01); *C07K 2317/33* (2013.01); *C07K 2317/51* (2013.01); *C07K 2317/56* (2013.01); *C07K 2317/565* (2013.01); *C07K 2317/74* (2013.01); *C07K 2317/76* (2013.01); *C07K 2317/92* (2013.01)

(58) Field of Classification Search
CPC ............ C07K 16/2896; C07K 16/2818; C07K 2317/51; C07K 2317/56; A61P 35/00; A61K 45/06; A61K 2039/505
See application file for complete search history.

(56) References Cited

U.S. PATENT DOCUMENTS

| | | |
|---|---|---|
| 3,710,795 A | 1/1973 | Higuchi et al. |
| 3,773,919 A | 11/1973 | Boswell et al. |
| 4,619,794 A | 10/1986 | Hauser |
| 4,676,980 A | 6/1987 | Segal et al. |
| 4,863,457 A | 9/1989 | Lee |
| 5,223,409 A | 6/1993 | Ladner et al. |
| 5,403,484 A | 4/1995 | Ladner |
| 5,427,908 A | 6/1995 | Dower |
| 5,501,856 A | 3/1996 | Ohtori et al. |
| 5,516,637 A | 5/1996 | Huang |
| 5,571,698 A | 11/1996 | Ladner |
| 5,580,717 A | 12/1996 | Dower |
| 5,591,828 A | 1/1997 | Bosslet et al. |
| 5,624,821 A | 4/1997 | Winter et al. |
| 5,648,260 A | 7/1997 | Winter et al. |
| 5,658,727 A | 8/1997 | Barbas |
| 5,698,426 A | 12/1997 | Huse |
| 5,733,743 A | 3/1998 | Johnson |
| 5,750,753 A | 5/1998 | Kimae |
| 5,780,225 A | 7/1998 | Wigler |
| 5,821,047 A | 10/1998 | Garrard |
| 5,858,358 A | 1/1999 | June et al. |
| 5,883,223 A | 3/1999 | Gray |

(Continued)

FOREIGN PATENT DOCUMENTS

| | | |
|---|---|---|
| EP | 0133988 A2 | 3/1985 |
| EP | 0058481 B1 | 10/1986 |

(Continued)

OTHER PUBLICATIONS

Virgilio "Purines, purinergic receptors, and cancer" (2012) Cancer Res 72(21):5441-5447.

(Continued)

*Primary Examiner* — Jeffrey Stucker
*Assistant Examiner* — Laura Ann Essex
(74) *Attorney, Agent, or Firm* — McNeill Baur PLLC

(57) ABSTRACT

The invention provides anti-CD39 antibody compositions and their use in treating cancer.

19 Claims, 36 Drawing Sheets
Specification includes a Sequence Listing.

(56) References Cited

U.S. PATENT DOCUMENTS

| | | |
|---|---|---|
| 5,969,108 A | 10/1999 | McCafferty |
| 6,001,329 A | 12/1999 | Buchsbaum et al. |
| 6,005,079 A | 12/1999 | Brussels |
| 6,194,551 B1 | 2/2001 | Idusogie et al. |
| 6,300,064 B1 | 10/2001 | Knappik et al. |
| 6,352,694 B1 | 3/2002 | June et al. |
| 6,534,055 B1 | 3/2003 | June et al. |
| 6,692,964 B1 | 2/2004 | June et al. |
| 6,797,514 B2 | 9/2004 | Berenson et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 6,933,368 B2 | 8/2005 | Co et al. |
| 6,984,720 B1 | 1/2006 | Korman et al. |
| 6,995,259 B1 | 2/2006 | Vargeese et al. |
| 7,067,318 B2 | 6/2006 | June et al. |
| 7,144,575 B2 | 12/2006 | June et al. |
| 7,172,869 B2 | 2/2007 | June et al. |
| 7,175,843 B2 | 2/2007 | June et al. |
| 7,232,566 B2 | 6/2007 | June et al. |
| 7,411,057 B2 | 8/2008 | Hanson et al. |
| 7,595,048 B2 | 9/2009 | Honjo et al. |
| 7,943,743 B2 | 5/2011 | Korman et al. |
| 8,008,449 B2 | 8/2011 | Korman et al. |
| 8,114,845 B2 | 2/2012 | Langermann et al. |
| 8,354,509 B2 | 1/2013 | Carven et al. |
| 8,728,474 B2 | 5/2014 | Honjo et al. |
| 8,779,105 B2 | 7/2014 | Korman et al. |
| 8,796,284 B2 | 8/2014 | Gomez et al. |
| 8,900,587 B2 | 12/2014 | Carven et al. |
| 8,952,136 B2 | 2/2015 | Carven et al. |
| 9,029,393 B2 | 5/2015 | Schann et al. |
| 9,067,999 B1 | 6/2015 | Honjo et al. |
| 9,073,994 B2 | 7/2015 | Honjo et al. |
| 9,133,197 B2 | 9/2015 | Cabri et al. |
| 10,738,128 B2 | 8/2020 | Chappel et al. |
| 10,793,637 B2 | 10/2020 | Chappel et al. |
| 2003/0040094 A1 | 2/2003 | Beaudoin et al. |
| 2005/0037382 A1 | 2/2005 | Robson et al. |
| 2005/0158280 A1 | 7/2005 | Robson et al. |
| 2006/0121005 A1 | 6/2006 | Berenson et al. |
| 2008/0241223 A1 | 10/2008 | Nivaggioli et al. |
| 2010/0303828 A1 | 12/2010 | Levy et al. |
| 2011/0287002 A1 | 11/2011 | Bukhalid et al. |
| 2015/0368361 A1 | 12/2015 | Bukhalid et al. |
| 2016/0129108 A1 | 5/2016 | Sachsenmeier et al. |
| 2016/0185861 A1 | 6/2016 | Bedoya et al. |
| 2017/0015758 A1 | 1/2017 | Hammond et al. |
| 2017/0281766 A1 | 10/2017 | Wiltzius |
| 2017/0335007 A1 | 11/2017 | Chen et al. |
| 2018/0009899 A1 | 1/2018 | Griffin et al. |
| 2019/0010230 A1 | 1/2019 | Monroe et al. |
| 2019/0062448 A1 | 2/2019 | Soros et al. |
| 2019/0071514 A1 | 3/2019 | Gauthier et al. |
| 2019/0275150 A1 | 9/2019 | Pincetic et al. |
| 2019/0284295 A1 | 9/2019 | Chappel et al. |
| 2021/0095041 A1 | 4/2021 | Chappel et al. |
| 2021/0363268 A1 | 11/2021 | Chappel et al. |

FOREIGN PATENT DOCUMENTS

| | | |
|---|---|---|
| EP | 0088046 B1 | 12/1987 |
| EP | 0143949 B1 | 10/1988 |
| EP | 0036676 B2 | 9/1990 |
| EP | 0404097 B1 | 12/1990 |
| EP | 0488401 A1 | 6/1992 |
| EP | 0430539 B1 | 10/1994 |
| EP | 1537878 A4 | 11/2006 |
| EP | 2170959 A1 | 4/2010 |
| EP | 2161336 B1 | 7/2013 |
| EP | 3153526 A1 | 4/2017 |
| EP | 2654789 B1 | 5/2018 |
| WO | 1990002809 A1 | 3/1990 |
| WO | 1991010737 A1 | 7/1991 |
| WO | 1992001047 A1 | 1/1992 |
| WO | 1992018619 A1 | 10/1992 |
| WO | 1993001161 A1 | 1/1993 |
| WO | 1993011236 A1 | 6/1993 |
| WO | 1993015722 A1 | 8/1993 |
| WO | 1994004678 A1 | 3/1994 |
| WO | 1994020069 A1 | 9/1994 |
| WO | 1994025591 A1 | 11/1994 |
| WO | 1994029351 A2 | 12/1994 |
| WO | 1995015982 A2 | 6/1995 |
| WO | 1995020401 A1 | 8/1995 |
| WO | 9622384 A1 | 7/1996 |
| WO | 1996027011 A1 | 9/1996 |
| WO | 1999051642 A1 | 10/1999 |
| WO | 2003052121 A2 | 6/2003 |
| WO | 2006111986 A1 | 10/2006 |
| WO | 2008024188 | 7/2008 |
| WO | 2009036379 A2 | 3/2009 |
| WO | 2007024715 A9 | 4/2009 |
| WO | 2009095478 A1 | 8/2009 |
| WO | 2009156737 A1 | 12/2009 |
| WO | 2010027827 A2 | 3/2010 |
| WO | 2010077634 A1 | 7/2010 |
| WO | 2010105256 A1 | 9/2010 |
| WO | 2011066342 A3 | 7/2011 |
| WO | 2011095625 A1 | 8/2011 |
| WO | 2012009568 A2 | 1/2012 |
| WO | 2012085132 A1 | 6/2012 |
| WO | 2013079174 A1 | 6/2013 |
| WO | 2013173223 A1 | 11/2013 |
| WO | 2015103072 A1 | 7/2015 |
| WO | 2016073845 A1 | 5/2016 |
| WO | 2016106159 A1 | 6/2016 |
| WO | 2017025918 A1 | 2/2017 |
| WO | 2017089334 A1 | 6/2017 |
| WO | 2017152102 A2 | 9/2017 |
| WO | 2017157948 A1 | 9/2017 |
| WO | 2018065552 A1 | 4/2018 |
| WO | 2019027935 A1 | 2/2019 |
| WO | 2019178269 | 9/2019 |

OTHER PUBLICATIONS

Virgilio and Adinolfi "Extracellular purines, purinergic receptors and tumor growth" (2017) Oncogene 36:293-303.
Wang and Guidotti, "CD39 is an Ecto-(CA2+,Mg2+)-apyrase" (1996) Journal of Biological Chemistry 271(17):9898-9901.
Wang and Wang, Current Opinion in Immunology, Feb. 15, 2007, 19:217-223.
Wang, Ou and Guidotti, "The Transmembrane Domains of Extoapyrase (CD39) Affect Its Enzymatic Activity and Quaternary Structure" (1998) Journal of Biological Chemistry 273(38):24814-24821.
Wang, T. F., et al., "CD39 is an Ecto(CA2+,Mg2+)-apyrase", J Biol Chem. 271(17): 9898-9901 (1996).
Warren, M. C. et al. "The fully human antibody SRF617 is potent enzymatic inhibitor of CD39 with strong immunomodulatory activity", Presented at SITC2019 on Nov. 9, 2019, Poster P652.
Welch and Redvanly (2003) "Handbook of Radiopharmaceuticals: Radiochemistry and Applications," John Wiley and Sons.
Whiteside "Disarming suppressor cells to improve immunotherapy" Cancer Immunol Immunother 61:283-288 (2012).
Whiteside et al. "The role of the adenosinergic pathway in immunosuppression mediated by human regulatory T cells (Treg)" Current Medicinal Chem. 18(34):5217-5223 (2011).
Wigler et al. "Transformation of mammalian cells with genes from procaryotes and eucaryotes" (1979) Cell 16:777-85.
Wright et al. "Antibody variable region glycosylation: position effects on antigen binding and carbohydrate structure" (1991) EMBO J 10(10):2717-2723.
Xian-Yang Li, et al., :Targeting CD39 in Cancer Reveals an Extracellular ATP- and Inflammasome-Driven Tumor Immunity, Cancer Discov. 9(12): 1754-1773 (2019).
Xu et al., "Addressing polyspecificity of antibodies selected from an in vitro yeast presentation system: a FACS-based, high-throughput selection and analytical tool." PEDS 26.10, 663-70 (2013).

(56) References Cited

OTHER PUBLICATIONS

Yang et al., "PD-L1: PD-1 interaction contributes to the functional suppression of T-cell responses to human uveal melanoma cells in vitro" (2008) Invest Ophthalmol Vis Sci 49(6):2518-2525.
Yeung et al. "Quantitative screening of yeast surface-displayed polypeptide libraries by magnetic bead capture" (2002) Biotechnol Prog 18:212-220.
Zapata et al. "Engineering linear F(ab')2 fragments for efficient production in *Escherichia coli* and enhanced antiproliferative activity" (1995) Protein Eng. 8(10):1057-1062.
Zhan et al., "From monoclonal antibodies to small molecules: the development of inhibitors targeting the PD-1/PD-L1 pathway" (2016) Drug Discov Today 21(6):1027-1036.
Zhang "CD73: A Novel Target for Cancer Immunotherapy" Cancer Res. 70(16):6407-6411 (2010).
Zhao et al., "What Else Can CD39 Tell Us?" (2017) Front Immunol 8:727.
Zhong and Guidotti, "A Yeast Golgi E-type ATPase with an Unusual Membrane Topology" (1999) Journal of Biological Chemistry 274(46):32704-32711.
Zhong, et al., "Mammalian Plasma Membrane Ecto-nucleoside Triphosphate Diphosphohydrolase 1, CD39, is Not Active Intracellularly" (2001) Journal of Biological Chemistry 276(44):41518-41525.
Zimmerman, H, "Two novel families of ectonucleoidases: molecular structures, catalytic properties and a search for function" (1999) TiPS 20:231-236.
Ramot and Nyska, "Drug-Induced Thrombosis—Experimental, Clinical and Mechanistic Considerations" (2007) Toxicologic Pathology 35:208-225.
Rawstron et al. "Chronic Lymphocytic Leukaemia (CLL) and CLL-Type Monoclonal B-Cell Lymphocytosis (MBL) show differential Expression of Molecules Involved in Lymphoid Tissue Homing" Cytometry 78B:S42-S46 (2010).
Reichmann et al., "Single domain antibodies: comparison of camel VH and camelised human VH domains" (1999) J. Immunol. Meth. 231:25-38.
Response dated Jun. 16, 2016, D45 from EP Opposition in EP2654789, as identified on the Consolidated list dated Sep. 19, 2019.
Roberts et al. "Chemistry for peptide and protein PEGylation" (2002) Advanced Drug Delivery Reviews 54:459-476.
Robson et al. "The E-NTPDase family of ectonuckeotidases: Structure function relationships and Pathophysiological significance" Purinergic Signalling 2:409-430 (2006).
Robson et al., "The E-NTPDase family of ectonucleotidases: Structure function relationships and pathophysiological significance", Purinergic Signalling, vol. 2, 409-430 (2006).
Rogers et al. "Localization of iodine-125-mIP-Des-Met14-bombesin (7-13)NH2 in ovarian carcinoma induced to express the gastrin releasing peptide receptor by adenoviral vector-mediated gene transfer" (1997) J Nucl Med 38:1221-1229.
Rondon and Marasco, "Intracellular antibodies (intrabodies) for gene therapy of infectious disease" (1997) Annu. Rev. Microbiol. 51:257-283.
Rossolini et al, "Use of deoxyinosine-containing primers vs degenerate primers for polymerase chain reaction based on ambiguous sequence information" Mol. Cell. Probes 8:91-98, 1994.
Sarver et al. "Transformation and replication in mouse cells of a bovine papillomavirus-pML2 plasmid vector that can be rescued in bacteria" (1982) Proc Natl Acad Sci USA, 79:7147.
Schaffitzel et al. "Ribosome display: an in vitro method for selection and evolution of antibodies from libraries" (1999) J Immunol Methods 231:119-135.
Schetinger Maria Rosa C et al: "NTPDase and 5'-nucleotidase activities in physiological and disease conditions: New perspectives for human health", Biofactors, vol. 31, No. 2, 2007, pp. 77-98.
Schoonbroodt et al. "Oligonucleotide-assisted cleavage and ligation: a novel directional DNA cloning technology to capture cDNAs. Application in the construction of a human immune antibody phage-display library." (2005) Nucleic Acids Res 33(9):e81.

Schuetz et al. "Molecular classification of renal tumors by gene expression profiling" J. of Molecular Diagnostics 7(2):206-218 (2005).
Schulze zur Wiesch, et al., "Comprehensive Analysis of Frequencey and Phenotype of T Regulatory Cells in HIV Infection: CD39 Expression of FoxP3+ T Regulatory Cells Correlates with Progressive Disease" (2011) J of Virology 85(3):1287-1297.
Shalaby et al., J. Exp. Med. "Development of humanized bispecific antibodies reactive with cytotoxic lymphocytes and tumor cells overexpressing the HER2 protooncogene" (1992) 175:217-225.
Shevach Ethan Met al: "The lifestyle of naturally occurring co4+ CD25 +Foxp3 + regulatory T cells", Immunological Reviews, vol. 212, Aug. 2006, pp. 60-73.
Shi et al. "De novo selection of high-affinity antibodies from synthetic fab libraries displayed on phage as pIX fusion proteins" (2010) JMB 397:385-396.
Shi et al. "Prevalence of the Mercurial-Sensitive EctoATPase in Human Small Cell Lung Carcinoma: Characterization and Partial Purification" Arch. Biochem. Biophys. 315(1):177-184 (1994).
Shimauchi et al., "Augmented expression of programmed death-1 in both neoplastic and non-neoplastic CD4+ T-cells in adult T-cell leukemia/lymphoma" (2007) Int J Cancer 121:2585-2590.
Shiraishi et al. "Short-step chemical synthesis of DNA by use of MMTrS group for protection of 5'-hydroxyl group" (2007) Nucleic Acids Symposium Series 51(1):129-130.
Shopes "A genetically engineered human IgG mutant with enhanced cytolytic activity" (1992) Immunol 148:2918-2922.
Sidman et al., "Controlled release of macromolecules and pharmaceuticals from synthetic polypeptides based on glutamic acid" Biopolymers, 22:547-556 (1983).
Siegel et al, "High efficiency recovery and epitope-specific sorting of an scFv yeast display library." J Immunol Methods 286(1-2), 141-153 (2004).
Sitkovsky et al. "Adenosine A2A receptor antagonists: blockade of adenosinergic effects and T regulatory cells" British J. of Pharmacology 153:S457-S464 (2008).
Sitkovsky et al., "Hostile, hypoxia-A2-adenosinergic tumor biology as the next barrier to overcome for tumor immunologists" (2014) Cancer Immunol Res) 2:598-605.
Sitkovsky et al., "Hypoxia-adenosinergic immunosuppression: tumor protection by T regulatory cells and cancerous tissue hypoxia" (2008) Clin Cancer Res 14:5947-5952.
Smith & Waterman, "Comparison of biosequences" Adv. Appl. Math. 2:482 (1981).
Songsivilai & Lachmann, "Bispecific antibody: a tool for diagnosis and treatment of disease" (1990) Clin. Exp. Immunol. 79:315-321.
Spatola, B. N. et al., "Fully human anti-CD39 antibody potently inhibits ATPase activity in cancer cells via uncompetitive allosteric mechanism", MASS 12(1); e1838036 (2020).
Spychala, J., "Tumor-promoting functions of adenosine," Pharmacol Ther., 87(2-3):161-73 (2000).
Stagg et al. "Extracellular adenosine triphosphate and adenosine in cancer" Oncogene 29:5346-5358 (2010).
Stahli et al., "Distinction of epitopes by monoclonal antibodies" Methods in Enzymology 92:242 (1983).
Sun et al. "CD39/ENTPD1 Expression by CD4+Foxp3+ Regulatory T-Cells Promotes Hepatic Metastatic Tumor Growth in Mice" Gastroenterology 139:1030-1040 (2010).
Suresh et al., "Bispecific monoclonal antibodies from hybrid hybridomas" (1986) Methods Enzymol. 121:210.
Szczepanski et al., Mechanisms of suppression used by regulatory T cells in patients newly diagnosed with acute myeloid leukemia, Blood, vol. 112(11) (2008).
Takenaka, Robson and Quintana, "Regulation of the T Cell Response by CD39" (2016) Trends in Immunology 37(7):427-439.
Thompson et al., "Significance of B7-H1 overexpression in kidney cancer" (2006) Clin Genitourin Cancer 5:206-211.
Todorovska et al., "Design and application of diabodies, triabodies and tetrabodies for cancer targeting" (2001) J. Immunol. Methods 248(1):47-66.
Trabanelli, et al., "Extracellular ATP Exerts Opposite Effects on Activated and Regulatory CD4+ T Cells via Purinergic P2 Receptor Activation" (2012) J Immunol 189:1303-1310.

(56) References Cited

OTHER PUBLICATIONS

Trautmann "Extracellular ATP in the immune system: more than just a danger signal". (2009) Sci Signal 2(56):pe6.
Traverso et al. "Analysis of Regulatory T-Cells in Patients affected by Renal Cell Carcinome" J. of Urology 183(4) (2010).
Tutt et al. "Trispecific F(ab')3 derivatives that use cooperative signaling via the TCR/CD3 complex and CD2 to activate and redirect resting cytotoxic T cells" (1991) J Immunol 147:60.
Van der Weyden, et al., "Genome-wide in vivo screen identifies novel host regulators of metastatic colonization" (2017) Nature.
Van Gurp et al. "Phase 1 dose-escalation study of CP-690 550 in stable renal allograft recipients: preliminary findings of safety, tolerability, effects on lymphocyte subsets and pharmacokinetics" (2008) Am J Transplantation 8(8):1711-1718.
Van Kuik-Romeijn et al. "Expression of a functional mouse-human chimeric anti-CD19 antibody in the milk of transgenic mice" (2000) Transgenic Res 9(2):155-159.
Vidarsson et al. "IgG subclasses and allotypes: from structure to effector functions" Front Immunol. (2014), 5: 520.
Vieweg et al., "Reveral of Tumor-Mediated Immunosuppression", Clin Can Res 2007;13(2 Suppl), Jan. 15, 2007.
Vijayan et al., "Targeting immunosuppressive adenosine in cancer" (2017) Nat Rev Cancer 17:709-724.
Cai, et al., "Overexpression of CD39 in hepatocellular carcinoma is an independent indicator of poor outcome after radical resection" (2016) Medicine 95:40.
Canale, et al., "CD39 Expression Defines Cell Exhaustion in Tumor-Infiltrating CD8+ T Cells" (2017) Cancer Res 78 (1):115-128.
Canfield et al."The binding affinity of human IgG for its high affinity Fc receptor is determined by multiple amino acids in the CH2 domain and is modulated by the hinge region" (1991) J Exp Med 173:1483-1491.
Caron et al. "Engineered humanized dimeric forms of IgG are more effective antibodies" (1992) J Exp Med 176:1191-1195.
Carrillo et al., "5-Fluorouracil derivatives: a patent review" (2012) Expert Opin Ther Pat 22(2):107-123.
Chasteen et al., "Eliminating helper phage from phage display" (2006) Nucleic Acids Res 34(21):e145.
Cheung et al., "Epitope-specific antibody response to the surface antigen of duck hepatitis B virus in infected ducks" Virology 176:546 (1990).
Clayton et al. "Cancer Exosomes Express CD39 and CD73, Which Suppresses T-Cells through Adenosine Production" J. of Immunology 187(2):676-683 (2011).
Co et al. "Genetically engineered deglycosylation of the variable domain increases the affinity of an anti-CD33 monoclonal antibody" (1993) Mol Immunol 30:1361.
Colombo et al. "Regulatory T-cell inhibition versus depletion: the right choice in cancer immunotherapy", Nature Reviews Cancer, vol. 7, Nov. 2007, 881-887.
Consolidated List of References EP 11801741.7 (EP2654789) Opposition, Sep. 19, 2019.
Consolidated List of References EP16198909.0 (EP3153526) Opposition, Jun. 23, 2021.
Coppi and Guidotti, "Inracellular Localization of Na,K-ATPase ?2 Subunit Mutants" (1997) Archives of Biochemistry and Biophysics 346(2):312-321.
Pages of the physical paper publication of D11 obtained from the United States National Library of Medicine, Bethesda, Maryland including the library date and time stamp "2008-10-0111:54:02" on the front page of the abstracts supplement, D11b from EP Opposition in EP16198909.0 as identified on the Consolidated List dated Jun. 23, 2021.
Cornelis "Expressing genes in different *Escherichia coli* compartments" (2000) Curr Opin Biotechnol 11:450-454.
Corriden, et al., "Ecto-nucleoside Triphosphate Diphosphohydrolase 1 (E-NTPDase1/CD39) Regulates Neutrophil Chemotaxis by Hydrolyzing Released ATP to Adenosine" (2008) Journal of Biological Chemistry (2008) 283 (42):28480-28486.

Covarrubias et al., "Role of the CD39/CD73 Purinergic Pathway in Modulating Arterial Thrombosis in Mice" Arterioscler Thromb Vasc Biol 36:1809-1820.
CrossRef (D25a), D52 from EP Opposition in EP11801741.7, as identified on the Consolidated list dated Sep. 19, 2019.
CrossRef (D7a), D48 from EP Opposition in EP11801741.7, as identified on the Consolidated list dated Sep. 19, 2019.
CrossRef (D8a), D50 from EP Opposition in EP11801741.7, as identified on the Consolidated list dated Sep. 19, 2019.
Curiel Tyler J., "Tregs and rethinking cancer immunotherapy", The Journal of Clinical Investigation, vol. 117, No. 5, May 2007.
Curiel, T., et al., "Specific recruitment of regulatory T cells in ovarian carcinoma fosters immune privilege and predicts reduced survival." Nat Med, 10(9):942-949 (2004).
D'Almeida, et al., "The ecto-ATPDase CD39 is involved in the acquisition of the immunoregulatory phenotype by M-DSF-macrophages and ovarian cancer tumor-associated macrophages: Regulatory role of IL-27" (2016) OncoImmunology.
Deaglio et al. "Adenosine generation catalyzed by CD39 and CD73 expressed on regulatory T-Cells mediates immune suppression" JEM 204(6):1257-1265 (2007).
Deans et al. "Expression of an immunoglobulin heavy chain gene transfected into lymphocytes" (1984) Proc Natl Acad Sci USA 81:1292.
Declaration of Achim K. Moesta, Ph. D, D70 from EP Opposition in EP 16198909.0 as identified on the Consolidated List dated Jun. 23, 2021.
Declaration of Dr. Francisco Quintana, 2021, D26 from EP Opposition in EP 16198909.0 as identified on the Consolidated List dated Jun. 23, 2021.
Declaration of Dr. Nathalie Bonnefoy Under 37 CFR 1.132 submitted during prosecution of A1 (5 pages), D27 from EP Opposition in EP 16198909.0 as identified on the Consolidated List dated Jun. 23, 2021.
Declaration of Dr. Nathalie Bonnefoy, dated Jan. 23, 2017, 7 pages, D27a from EP Opposition in EP 16198909.0 as identified on the Consolidated List dated Jun. 23, 2021.
Di Niro et al. "Characterizing monoclonal antibody epitopes by filtered gene fragment phage display" (2005) Biochem J 388(Pt 3):889-894.
Dong et al. "B7-H1 pathway and its role in the evasion of tumor immunity" (2003) J. Mol. Med. 81:281-7.
Dong et al., "Protect the killer: CTLs need defenses against the tumor" (2002) Nat Med 8:787-789.
Dong et al., "Tumor-associated B7-H1 promotes T-cell apoptosis: a potential mechanism of immune evasion" (2002) Nat Med 8(8):793-800.
Dr. N. Bonnefoy's CV, D27b from EP Opposition in EP 16198909.0 as identified on the Consolidated List dated Jun. 23, 2021.
Dulphy, et al., "Contribution of CD39 to the immunosuppressive microenvironment of acute myeloid lukaemia at diagnosis" (2014) British Journal of Haematology.
Dunleavy "Double-hit lymphomas: current paradigms and novel treatment approaches" (2014) Hematology Am Soc Hematol Educ Program 2014(1):107-112.
Dwyer et al. "CD39 and control of cellular immune responses" Purinergic Signalling 3:171-180 (2007).
Dwyer et al.: "CD39 and control of cellular immune D3 responses", Purinergic Signalling, vol. 3, Feb. 6, 2007, pp. 171-180.
Dwyer, et al., "Thromboregulatory manifestations in human CD39 transgenic mice and the implications for thrombotic disease and transplantation" (2004) Journal of Clinical Investigation 113(10):1440-1446.
Dzhandzhugazyan et al. "Ecto-ATP Diphosphohydrolase/CD39 is Overexpressed in Differentiated Human Melanomas" FEBS Letters 430(3):227-230 (1998).
Elliot et al., "Nucleotides released by apoptotic cells act as a find-me signal to romot phagocytic clearance" (2009) Nature 461:282-287.
Eltzschig et al., "Purinergic signaling during inflammation" (2012) N Engl J Med 367:2322-2333.
Engberg et al. "Phage-display libraries of murine and human antibody Fab fragments" (1995) Methods Mol Biol 51:355-376.

(56) References Cited

OTHER PUBLICATIONS

Engel, P. et al. "The B7-2 (B70) costimulatory molecule expressed by monocytes and activated B lymphocytes is the CD86 differentiation antigen" 1994, Blood 84: 1402.
Enjyoji et al., "Targetd disruption of cd39/ATP diphosphohydrolase results in disordered hemosasis and thromboregulation" (1999) Nature Medicine 5(9):1010-1017.
Epitope Mapping Protocols in Methods in Molecular Biology, vol. 66, G. E. Morris, Ed. (1996).
Eppstein et al, "Biological activity of liposome-encapsulated murine interferon gamma is mediated by a cell membrane receptor" Proc. Natl. Acad Sci. USA, 82:3688-3692 (1985).
Estep et al. "High throughput solution-based measurement of antibody-antigen affinity and epitope binning" (2013) Mabs 5(2):270-278.
Etz et al. "Bacterial phage receptors, versatile tools for display of polypeptides on the cell surface" (2001) J Bacteriol 183:6924-6935.
Exhibit 1, D53 from EP Opposition in EP11801741.7, as identified on the Consolidated list dated Sep. 19, 2019.
Lonberg & Huszar, "Human antibodies from transgenic mice" (1995) Intern. Rev. Immunol. 13:65-93.
Lonberg et al., "Antigen-specific human antibodies from mice comprising four distinct genetic modifications" (1994) Nature 368(6474): 856-859.
Maliszewski et al., "The CD39 lymphoid cell activation antigen. Molecular cloning and structural characterization" (1994) Journal of Immunology 153:3574-3583.
Mandapathil et al. "Increased Ectonucleotidase Expression and Activity in Regulatory T-Cells of Patients with Head and Neck Cancer" Clin Cancer Res. 15(20):6348-6357 (2009).
Mandapathil et al. "Targeting human inducible regulatory T-Cell (Tr1) in patients with cancer: blocking of adenosine-prostaglandin E2 cooperation" Expert Opin Biol Ther. 11(9):1203-1214 (2011).
Mandapathil, et al., "Generation and Accumulation of Immunosuppressive Adenosine by Human CD4+CD25highFoxP3+ Regulatory T Cells" (2010) 285(10):7176-7186.
Marcus et al., "Role of CD39 (NTPDAse-1) in Thromboregulation, Cerebroprotection, and Cardioprotection" (2005) Seminars in Thrombosis and Hemostasis 31(2):234-246.
Marcus et al., "The Endothelial Cell Ecto-ADPase Responsible for Inhibition of Platelet Function is CD39" (1997) Journal of Clinical Inestigation 99(6):1351-1360.
Martins et al., "Molecular mechanisms of ATP secretion during immunogenic cell death" (2014) Cell Death Differ 21(1):79-91.
Mascanfroni, et al., "Interleukin-27 acts on dendritic cells to suppress the T-cell response and autoimmunity by inducing the expression of ENTPD1 (CD39)" (2013) 14(10):1054-1063.
McGlasson and Fritsma, "Whole Blood Platelet Aggregometry and Platelet Function Testing" (2009) Seminars in Thrombosis and Hemostasis 35(2):168-180.
Merz et al. (1995) "Generating a phage display antibody library against an identified neuron" J Neurosci Methods 62(1-2):213-9.
Meyer et al. "Expression of CD39 and CD73 as means of Evading Antitumor immune responses in Lung Cancer" J. of Immunology 184 (2010).
Meyers and Miller "Optimal alignments in linear space" CABIOS, 4:11-17 (1989).
Minotti et al., "Anthracyclines: molecular advances and pharmacologic developments in antitumor activity and cardiotoxicity" (2004) Pharmacol Rev 56(2):185-229.
Moesta, A. K., et al., "Targeting CD39 in cancer", Nat Rev Immunol 20(12): 739-755 (2020).
Moldenhauer et al., "Identity of HML-1 antigen on intestinal intraepithelial T cells and of B-ly7 antigen on hairy cell leukaemia" Scand. J Immunol. 32:77 (1990).
Moller Sina et al: "Monitoring the expression of purinoceptors and nucleotide-metabolizing ecto-enzymes with antibodies directed against proteins in native conformation ", Purinergic Signalling Sep. 2007, vol. 3, No. 4, Sep. 2007, pp. 359-366.

Moncrieffe, et al., "High Expression of the Ectonucleotidase CD39 on T Cells from the Inflamed Site Identifies Two Distinct Populations, One Regulatory and One Memory T Cell Population" (2010) J Immunol 185(1):134-143.
Morel et al., "Monoclonal antibodies to bovine serum albumin: affinity and specificity determinations" Mol. Immunol. 25(1):7 (1988).
Mueller et al. "Humanized porcine VCAM-specific monoclonal antibodies with chimeric IgG2/G4 constant regions block human leukocyte binding to porcine endothelial cells" (1997) Mol Immunol 34(6):441-452.
Muller-Haegele et al., "Immunoregulatory activity of adenosine and its role in human cancer progression" (2014) Expert Rev Clin Immunol 10:897-914.
Mulligan and Berg "Selection for animal cells that express the *Escherichia coli* gene coding for xanthine-guanine phosphoribosyltransferase" (1981) Proc Natl Acad Sci USA 78:2072.
Muyldermans et al., "Recognition of antigens by single-domain antibody fragments: the superfluous luxury of paired domains" (2001) Trends Biochem. Sci. 26:230-235.
Nakanishi et al., "Overexpression of B7-H1 (PD-L1) significantly associates with tumor grade and postoperative prognosis in human urothelial cancers" (2007) Cancer Immunol Immunother 56:1173-1182.
Needleman and Wunsch "A general method applicable to the search for similarities in the amino acid sequence of two proteins" J. Mol. Biol. (48):444-453 (1970).
Newman et al. "Modification of the Fc region of a primatized IgG antibody to human CD4 retains its ability to modulate CD4 receptors but does not deplete CD4(+) T cells in chimpanzees" Clinical Immunol. (2001)98(2): 164-174.
Nikolova, et al., "CD39/Adenosine Pathway is Involved in AIDS Progression" (2011), PLoS Pathogens 7(7).
Notice of allowance issued in U.S. Appl. No. 16/352,589 dated Jun. 10, 2020.
Nozawa Y. et al., "A novel monoclonal antibody (FUN-1) identifies an activation antigen in cells of the B-cell lineage and Reed-Sternberg cells" 1993, J. Pathology 169: 309.
Nuttall et al., "Immunoglobulin VH domains and beyond: design and selection of single-domain binding and targeting reagents" (2000) Curr. Pharm. Biotech. 1:253-263.
Official Letter dated Dec. 11, 2015, D44 from EP Opposition in EP11801741.7, as identified on the Consolidated list dated Sep. 19, 2019.
Official Letter dated Jan. 27, 2017, D46 from EP Opposition in EP11801741.7, as identified on the Consolidated list dated Sep. 19, 2019.
Ohigashi et al., "Clinical significance of programmed death-1 ligand-1 and programmed death-1 ligand-2 expression in human esophageal cancer" (2005) Clin Cancer Res 11:2947-2953.
Ohta et al. "A2A Adenosine Receptor Protects Tumors from Antitumor T-Cells" PNAS 103(35):13132-13137 (2006).
Ohta et al., "Role of G-protein-coupled adenosine receptors in downregulation of inflammation and protection from tissue damage" (2001) Nature 414:916-920.
Ohtsuka et al., "An alternative approach to deoxyoligonucleotides as hybridization probes by insertion of deoxyinosine at ambiguous codon positions" Biol Chem. 260:2605-2608, 1985.
Orru, et al., "Genetic Variants Regulating Immune Cell Levels in Health and Disease" (2013) Cell 155:242-256.
Patentee's response to USPTO of Aug. 18, 2015, D65 from EP Opposition in EP 16198909.0 as identified on the Consolidated List dated Jun. 23, 2021.
Pavisic et al. "Recombinant human granulocyte colony stimulating factor pre-screening and screening of stabilizing carbohydrates and polyols" (2010) Int J Pharm 387(1-2):110-119.
Pearson & Lipman, "Improved tools for biological sequence comparison" Proc. Nat'l. Acad. Sci. USA 85:2444 (1988).
Persic et al. "An integrated vector system for the eukaryotic expression of antibodies or their fragments after selection from phage display libraries" (1997) Gene 187:9-18.
Plunkett et al., "Gemcitabine: metabolism, mechanisms of action, and self-potentiation" (1995) Semin Oncol 22(4 Suppl 11):3-10.

(56) References Cited

OTHER PUBLICATIONS

Poljak, "Production and structure of diabodies" (1994) Structure 2(12):1121-1123.
Pollock et al. "Transgenic milk as a method for the production of recombinant antibodies" (1999) J Immunol Methods 231(1-2):147-157.
Pommier et al., "DNA topoisomerases and their poisoning by anticancer and antibacterial drugs" (2010) Chem Biol 17(5):421-433.
Product datasheet for the anti-CD39 antibody A 1, Biolegend, D12 from EP Opposition in EP 16198909.0 as identified on the Consolidated List dated Jun. 23, 2021.
Pulte et al. "CD39 activity correlates with stage and inhibits platelet reactivity in chronic lymphocytic leukemia" J. Translational Medicine 5(23):1-10 (2007).
Pulte et al., "CD39 expression on T lymphocytes correlates with severity of disease in patients with chronic lymphocytic leukemia" (2011) Clin Lymphoma Myeloma Leuk 11:367-372.
Pulte et al., "CD39/NTPDase-1 Activity and Expression in Normal Leukocytes" (2007) Thromb Res. 121(3):309-317.
Exhibit 2, D54 from EP Opposition in EP11801741.7, as identified on the Consolidated list dated Sep. 19, 2019.
Exhibit 3, D55 from EP Opposition in EP11801741.7, as identified on the Consolidated list dated Sep. 19, 2019.
Exhibit A filed by the Proprietor with response to USPTO dated Feb. 20, 2015, D55 from EP Opposition in EP 16198909.0 as identified on the Consolidated List dated Jun. 23, 2021.
Exhibit A, D27c from EP Opposition in EP 16198909.0 as identified on the Consolidated List dated Jun. 23, 2021.
Exhibit B, D27d from EP Opposition in EP 16198909.0 as identified on the Consolidated List dated Jun. 23, 2021.
Fan et al., "Identification of CD4+ T-cell-derived CD161+ CD39+ and CD39+CD73+ microparticles as new biomarkers for rheumatoid arthritis" (2017) Biomark Med 11:107-116.
Fang, et al., "Expression of CD39 on Activated T Cells Impairs their Survival in Older Individuals" (2016) Cell Reports 14:1218-1231.
Fecci et al., "Systemic Anti-CD25 Monocloncal Antibody Administration Safely Enhances Immunity in Murine Glioma without Eliminating Regulatory T Cells", Clin Cancer Res 2006 :12(14) Jul. 15, 2006, 4294-4305.
Fredholm "Adenosine, an endogenous distress signal, modulates tissue damage and repair" Cell Death and Differentiation 14:1315-1523 (2007).
Fujarewicz et al. "A Multi-gene Approach to differentiate papillary Thyriod Carcinoma from benign lesions: Gene selection using support vector machines with bootstrapping" Endocrine-Related Cancer 14:809-826 (2007).
Fulmer, "A gut feeling for CD39" Science-Business eXchange (2009) 2(40).
Gao et al., "Overexpression of PD-L1 significantly associates with tumor aggressiveness and postoperative recurrence in human hepatocellular carcinoma" (2009) Clin Cancer Res 15:971-979.
Gebremeskel and Johnston "Concepts and mechanisms underlying chemotherapy induced immunogenic cell death impact on clinical studies and considerations for combined therapies" (2015) 6(39):41600-41619.
GenBank Accession No. AAC51773.
GenBank Accession No. Q9NZQ7.
Gershon, R.K., et al., "Infectious immunological tolerance," Immunoloav, 21 :903-914 (1971).
Ghebeh et al., "The B7-H1 (PD-L1) T lymphocyte-inhibitory molecule is expressed in breast cancer patients with infiltrating ductal carcinoma: correlation with important high-risk prognostic factors" (2006) Neoplasia 8:190-198.
Goettel, J.A., et al., "AHR Activation is Protective against Colitis Driven by T Cells in Humanized Mice," Cell Rep. 17(5):1318-1329 (2016).
Gourdin, et al., "Autocrine Adenosine regulates tumor polyfunctional CD73+CD4+ effector T cells devoid of immune checkpoints" (2018) Cancer Research.

Gouttefangeas "Biochemcial Analysis and Epitope mapping of mAb desining CD39 . . . " Proceedings pf the 5th International Workshop; Abstract T17 (1995).
Gouttefangeas, C., et al., "The CD39 molecule defines distinct cytotoxic subsets within alloactivated human CDS-positive cells" Eur J. Immunol , 22:2681-2685 (1992).
Grabher et al. "The baculovirus expression system as a tool for generating diversity by viral surface display" (2001) Comb Chem High Throughput Screen 4:185-192.
Grinthal and Guidoti, "Bilayer mechanical properties regulate transmembrane helix mobility and enzymatic state of CD39" (2007) Biochemistry 46(1):279-290.
Gruber et al., "Efficient tumor cell lysis mediated by a bispecific single chain antibody expressed in *Escherichia coli*" (1994) J. Immunol. 152:5368.
Guesdon, J.-L. et al., "The use of avidin-biotin interaction in immunoenzymatic techniques" 1979, J. Histochem. Cytochem. 27: 1131-1139.
Gupta et al. "Adjuvants for human vaccines-current status, problems and future prospects" (1995) Vaccine 13(14): 1263-1276.
Gupta, et al., "CD39 Expression Identifies Terminally Exhausted CD8+ T Cells" (2015) Plos Pathogens 11(10).
Hamanishi et al., "Programmed cell death 1 ligand 1 and tumor-infiltrating CD8+ T lymphocytes are prognostic factors of human ovarian cancer" (2007) Proc Nat Acad Sci USA 104:3360-3365.
Hanouska et al. "Phase 1b dose escalation study of erlotinib in combination with infusional 5-Fluorouracil, leucovorin, and oxaliplatin in patients with advanced solid tumors" (2007) Clin Cancer Res 13(2, part 1):523-531.
Harding & Lonberg, "Class switching in human immunoglobulin transgenic mice" (1995) Ann. N.Y. Acad. Sci. 764:536-546.
Häusler et al. "CD39 Wird in vivo und in vitro von Ovarialkarzinomzellen expirmiert und inhitiert die lytische Aktivitat von NK-Zellen" Geburtshilfe Frauenheilkunded 69:P106 (2009) German (English translation cited separately).
Häusler et al. "CD39 Wird in vivo und in vitro von Ovarialkarzinomzellen expirmiert und inhitiert die lytische Aktivitat von NK-Zellen" Geburtshilfe Frauenheilkunded 69:P106 (2009) English.
Häusler et al. "Ectonucleotidases CD39 and CD73 on OvCA cells are potent adenosine-generating enzymes responsible for adenosine receptor 2A-dependent suppression of T cell function and NK cell cytotoxicity" Cancer Immunol Immunother 60:1405-1417 (2011).
Häusler et al. Geburtshilfe Frauenheilkd (2009) 69-A042 (Abstract for XXI. Akademische Tagung deutsch sprechender ochschullehrer in der Gynakologie und Geburtshilfe—Innsbruck) German (English translation cited separately).
Häusler et al. Geburtshilfe Frauenheilkd (2009) 69-A042 (Abstract for XXL Akademische Tagung deutsch sprechender ochschullehrer in der Gynakologie und Geburtshilfe—Innsbruck) English.
Häusler et al., poster "D39 is expressed by human ovarian carcinoma cell lines and inhiitos immunological tumour defence" (date: 2008).
Häusler et al., poster: "CD39 is expressed in vivo and in vitro by ovarian carcinoma cells and inhibits the lytic activity of NK cells" (date: 2009).
Hausler et al: "CD39 is expressed by human ovarian carcinoma cell lines and inhibits immunological tumour defence", Abstract, Thieme Ejournals—Obstetrics, Gynecology, 2008 Retrieved from the Internet: URL:https://www.thiemeconnect.de/products/ejournals/abstract/10.1055/s-0028-1, includes English translation.
Häusler Geburtshilfe Frauenheilkd (2008) 68: SI-S194 (68:PO-Onko_04.33) (Abstract for Kongress der Deutschen Gesellschaft fur Gynakologie und Geburtshilfe—Hamburg) German (English translation provided).
Hausler, S.F.M., et al., "Anti-CD39 and anti-CD73 antibodies A 1 and 7G2 improve targeted therapy in ovarian cancer by blocking adenosine-dependent immune evasion" Am J Transl Res, 6(2):129-139 (2014).
Hetherington et al. "Phase I dose escalation study to evaluate the safety and pharmacokinetic profile of tefibazumab in subjects with end-stage renal disease requiring hemodialysis" (2006) Antimicrobial Agents and Chemotherapy 50(10):3499-3500.

(56) References Cited

OTHER PUBLICATIONS

Hino et al., "Tumor cell expression of programmed cell death-1 ligand 1 is a prognostic factor for malignant melanoma" (2010) Cancer 116(7):1757-1766.
Hodgson et al., "Characterization of the potent and highly selective A2A receptor antagonists preladenant and SCH 412348[7-[2-[4-2,4-difluorophenyl]-1-piperazinyllethyl]-2-(2-furanyl)-7H-pyrazolo[4,3-e][1,2,4]triazolo[1,5-c]pyrimidin-5-amine] in rodent models of movement disorders and depression" (2009) J Pharmacol Exp Ther 330(1):294-303.
Hodi, F.S., et al., "Biologic activity of cytotoxic T lymphocyte-associated antigen 4 antibody blockade in previously vaccinated metastatic melanoma and ovarian carcinoma patients," Proc Natl Acad Sci USA., 100(8):4712-4717 (2003).
Horenstein, et al., "A CD38/CD203a/CD73 ectoenzymatic pathway independent of CD39 drives a novel adenosinergic loop in human T lymphocytes" (2013) OncoImmunology 2(9):e26246-1-e26246-14.
Feng et al., "Vascular CD39/ENTPD1 Directly Promotes Tumor Cell Growth by Scavenging Extracellular Adenosine Triphosphate", Neoplasia, vol. 13, No. 3, Mar. 2011, pp. 206-216.
Hou "Comparison of Multiple Comparison methods for Identifying Differential Gene Expression in simulated and Real Papillary Thyroid Cancer Microarry Data" Presented to the Faculty of the Univeristy of Texas School of Public Health (2009).
Hou et al. "Expression of active thrombopoietin and identification of its key residues responsible for receptor binding" (1998) Cytokine 10:319-30.
Houdebine "Antibody manufacture in transgenic animals and comparisons with other systems" (2002) Curr Opin Biotechnol 13(6):625-629.
Huang et al., "Role of A2a extracellular adenosine receptor-mediated signaling in adenosine-mediated inhibition of T-cell activation and expansion" (1997) Blood 90-1600-1610.
Hudson and Kortt, "High avidity scFv multimers; diabodies and triabodies" (1999) J. Immunol. Methods 231(1):177-189.
Hudson et al., "Engineered antibodies" Nat. Med. 9:129-134 (2003).
Idzko et al., "Nucleotide signalling during inflammation" (2014) Nature 509:310-317.
Inman et al., "PD-L1 (B7-H1) expression by urothelial carcinoma of the bladder and BCG-induced granulomata associations with localized stage progression" (2007) Cancer 109:1499-1505.
Innate Pharma. Targeting CD39 and CD73 to Improve Anti-Tumour Immune Responses, Nov. 15, 2017, pp. 17-18 [online]. [Retrieved May 29, 2019). Retrieved from the internet: . Especially PDF p. 17-18.
International Search Report and Written Opinion issued in PCT/US2019/022108 dated Sep. 3, 2019.
International Search Report and Written Opinion issued in PCT/US2020/050829 dated Jan. 4, 2021.
Internet Archive Wayback machine (D25a), D51 from EP Opposition in EP11801741.7, as identified on the Consolidated list dated Sep. 19, 2019.
Internet Archive Wayback machine (D7a), D47 from EP Opposition in EP11801741.7, as identified on the Consolidated list dated Sep. 19, 2019.
Internet Archive Wayback machine (D8a), D49 from EP Opposition in EP11801741.7, as identified on the Consolidated list dated Sep. 19, 2019.
Ishida, Y. et al. "Induced expression of PD-1, a novel member of the immunoglobulin gene superfamily, upon programmed cell death" (1992) EMBO J. 11:3887-3895.
Iwai et al. "Involvement of PD-L1 on tumor cells in the escape from host immune system and tumor immunotherapy by PD-L1 blockade" (2002) Proc. Nat'l. Acad. Sci. USA 99:12293-7.
Jackson, S.W., et al., "Disordered purinergic signaling inhibits pathological angiogenesis in cd39/Entpd1-null mice." Am J Pathol., 171(4):1395-1404 (2007).

Jin et al. "CD73 on Tumor Cells Impairs Antitumor T-Cell Responses: A Novel Mechanism of Tumor-Induced Immune Suppression" Cancer Research 70(6):2245-2255 (2010).
Johnson et al. "3-O-Desacyl monophosphoryl lipid A derivatives: synthesis and immunostimulant activitiesLodmell et al. "DNA vaccination of mice against rabies virus: effects of the route of vaccination and the adjuvant monophosphoryl lipid A (MPL)" (2000) Vaccine 18:1059-1066" (1999) J Med Chem 42:4640-4649.
Kaczmarek E., et al., Identification and Characterization of CD39/Vascular ATP Diphosphohydrolase, Journal of Biological Chemistry, vol. 271, No. 51, Issue of Dec. 20, pp. 33116-33122, 1996.
Kansas, G.S., et al., "Expression, distribution, and biochemistry of human CD39. Role in activation-associated homotypic adhesion of lymphocytes," J Immunol., 146(7):2235-44 (1991).
Kanthi, et al., "Flow-dependent expression of ectonucleotide tri(di) phosphohydrolase-1 and suppression of atherosclerosis" (2015) Journal of Clinical Investigation 125(8) 3021-3036.
Kaszubska et al. "Expression, purification, and characterization of human recombinant thrombopoietin in Chinese hamster ovary cells" (2000) Protein Expression and Purification 18:213-220.
Kettleborough et al. "Isolation of tumor cell-specific single-chain Fv from immunized mice using phage-antibody libraries and the re-construction of whole antibodies from these antibody fragments" (1994) Eur J Immunol 24:952-958.
Khakh et al., "P2X receptors as cell-surface ATP sensors in health and disease" (2006) Nature 442:527-532.
Kieke et al. "Isolation of anti-T cell receptor scFv mutants by yeast surface display" (1997) Protein Eng 10:1303-1310.
Kimura et al., "Treatment of malignant lymphomas with bleomycin" (1972) Cancer 29(1):58-60.
Kinstler et al. "Kinstler et al. (2002) Advanced Drug Deliveries Reviews 54:477-485" (2002) Advanced Drug Deliveries Reviews 54:477-485.
Kirkland et al., "Analysis of the fine specificity and cross-reactivity of monoclonal anti-lipid A antibodies" J. Immunol. 137:3614 (1986).
Kishore et al. "Expression of NTPDase1 and NTPDase2 in murine kidney: relevance to regulation of P2 receptor signaling" Am. J. Physiol. Renal Physiol 288:F1032-F1043 (2005).
Kitano et al., "Tumour-infiltrating lymphocytes are correlated with higher expression levels of PD-1 and PD-L1 in early breast cancer" (2017) ESMO Open 2(2):e000150.
Kleffel et al., "Melanoma Cell-Intrinsic PD-1 Receptor Functions Promote Tumor Growth" (2015) Cell 162(6):1242-1256.
Klemm et al. "Fimbrial surface display systems in bacteria: from vaccines to random libraries" (2000) Microbiology 146:3025-3032.
Knowles et al., "Inhibition of an ecto-ATP-diphosphohydrolase by azide". Eur J Biochem 262, 349-357 (1999).
Knowles, A. F., et al.,"The common occurrence of ATP diphosphohydrolase in mammalian plasma membranes", Biochim Biophys Acta 26; 731(1):88-96 (1983).
Knutson et al., "IL-2 Immunotoxin Theraphy Modulates Tumor-Associated Regulatory T Cells and Leads to Lasting Immune-Mediated Rejection of Breast Cancers in neu-Transgenic Mice", The Journal of Immunology, 2006,177: 84-91.
Kobie, et al., "T Regulatory and Primed Uncommitted CD4 T Cells Express CD73, Which Suppresses Effector CD4 Cells by Converting 5'-Adenosine Monophosphate to Adenosine", J Immunol. 177: 6780-6786 (2006).
Kondo et al. "Expression of CD73 and its ecto-5'-nucleotidase activity are elevated in papillary thyroid carcinomas" Histopathology 48:612-614 (2006).
Konishi et al. "B7-H1 expression on non-small cell lung cancer cells and its relationship with tumor-infiltrating lymphocytes and their PD-1 expression" (2004) Clin. Cancer Res 10:5094-100.
Kostelny et al., "Formation of a bispecific antibody by the use of leucine zippers" (1992) J. Immunol. 148(5):1547-1553.
Kunzli et al. "Upregulation of CD39/NTPDases and P2 receptors in himan pancreatic disease" Am. J. Gastrointest Liver Physiol 292:G223-G230 (2007).
Langer et al., "Biocompatibility of polymeric delivery systems for macromolecules" J. Biomed. Mater. Res., 15: 167-277 (1981).

(56) References Cited

OTHER PUBLICATIONS

Lapierre, et al., "Disruption of the CD39 immune checkpoint pathway increases the efficacy of various anticancer therapies in syngeneic mouse tumor models" (2016) AACR Poster.
Lee et al. "Prolonged circulating lives of single-chain Fv proteins conjugated with polyethylene glycol: a comparison of conjugation chemistries and compounds" (1999) Bioconjug Chem 10(6): 973-8.
Leoni et al., "Bendamustine (Treanda) displays a distinct pattern of cytotoxicity and unique mechanistic features compared with other alkylating agents" (2008) Clin Cancer Res 14(1):309-317.
LeWitt et al., "Adenosine A2A receptor antagonist istradefylline (KW-6002) reduces "off" time in Parkinson's disease: a double-blind, randomized, multicenter clinical trial (6002-US-005)" (2008) Ann Neurol 63(3):295-302.
Liao et al., "CAMP/CREB-mediated Transcriptional Regulaton of Ectonucleoside Triphosphate Diphosphyhydrolase 1 (CD39) Expression" (2010) Journal of Biological Chemistry 285(19):14791-14805.
Lodmell et al. "DNA vaccination of mice against rabies virus: effects of the route of vaccination and the adjuvant monophosphoryl lipid A (MPL)" (2000) Vaccine 18:1059-1066.
Lokshin et al., "Adenosine-mediated inhibition of the cytotoxic activity and cytokine production by activated natural killer cells" (2006) Cancer Res 66:7758-7765.
Lonberg "Human antibodies from transgenic animals" (2005) Nature Biotech. 23(9):1117-1125.
"Exhibit A" submitted by Patentee on Mar. 26, 2019, D61 from EP Opposition in EP 16198909.0 as identified on the Consolidated List dated Jun. 23, 2021.
May 10, 2019 Observations by Third Party, D49 from EP Opposition in EP 16198909.0 as identified on the Consolidated List dated Jun. 23, 2021.
Nov. 12, 2019 Preliminary Opinion of Opposition Division in Opposition Against EP 2654789, D50 from EP Opposition in EP 16198909.0 as identified on the Consolidated List dated Jun. 23, 2021.
Jul. 15, 2019 Summons to Attend Oral Proceedings and Annex, D48 from EP Opposition in EP 16198909.0 as identified on the Consolidated List dated Jun. 23, 2021.
Sep. 25, 2018 Communication from the Examining Division and Annex, D43 from EP Opposition in EP 16198909.0 as identified on the Consolidated List dated Jun. 23, 2021.
Mar. 26, 2019 Claim Amendment with Annotations, Auxiliary Claim Set 2, D45 from EP Opposition in EP 16198909.0 as identified on the Consolidated List dated Jun. 23, 2021.
Mar. 26, 2019 Reply to the Communication from the Examining Division, D44 from EP Opposition in EP 16198909.0 as identified on the Consolidated List dated Jun. 23, 2021.
Feb. 28, 2020 Written Submission in Preparation for Oral Proceedings, D47 from EP Opposition in EP 16198909.0 as identified on the Consolidated List dated Jun. 23, 2021.
Jan. 30, 2020 Written Submission in Preparation for Oral Proceedings, D46 from EP Opposition in EP 16198909.0 as identified on the Consolidated List dated Jun. 23, 2021.
Abal et al., "Taxanes: microtubule and centrosome targets, and cell cycle dependent mechanisms of action" (2003) Curr Cancer Drug Targets 3(3):193-203.
Aiello, A. et al., "Expression of differentiation and adhesion molecules in sporadic Burkitt's lymphoma", Hematologocial Oncology, 8(4): 229-238 (1990).
Allard et al., "CD73-adenosine: a next-generation target in immuno-oncology" (2016) Immunotherapy 8:145-163.
Allard et al., "Immunosuppressive activities of adenosine in cancer" (2016) Curr Opin Pharmacol 29:7-16.
Allard, et al., "The ectonucleotidases CD39 and CD73: novel checkpoint inhibitor targets" (2017) Immunol Rev. 276(1):121-144.
Altschul et al., "Basic local alignment search tool" J. Mol. Biol. 215:403-410 (1990).
Altschul et al., "Gapped BLAST and PSI-BLAST: a new generation of protein database search programs" (1997) Nucleic Acids Res. 25(17):3389-3402.
Ames et al. "Conversion of murine Fabs isolated from a combinatorial phage display library to full length immunoglobulins" (1995) J Immunol Methods 184:177-186.
Antonioli et al., "CD39 and CD73 in immunity and inflammation" (2013) Trends Mol Med 19:355-367.
Antonioli et al., "Immunity, inflammation and cancer: a leading role for adenosine" (2013) Nat Rev Cancer 13:842-857.
Applicant's letter to USPTO, Jan. 26, 2017, D57 from EP Opposition in EP 16198909.0 as identified on the Consolidated List dated Jun. 23, 2021.
Augier et al., "Preclinical development of a humanized blocking antibody targeting the CD39 immune checkpoint for cancer immunotherapy" (2016) AACR Poster.
Azuma M. et al., "B70 antigen is a second ligand for CTLA-4 and CD28" 1993, Nature 366: 76.
Bai, et al., "CD39 and CD161 Modulate Th17 Responses in Chrohn's Disease" (2014) J Immunol 193:3366-3377.
Baldridge et al. "Monophosphoryl lipid A (MPL) formulations for the next generation of vaccines" (1999) Methods 19:103-107.
Banz, et al., "CD39 is incorporated into plasma microparticles where it maintains functional properties and impacts endothelial activation" (2008) Br J Haematol 142(2):627-637.
Bastid et al. "ENTPD1/CD39 is a promising therapeutic target in oncology" Oncogene 32:1743-1751 (2013).
Bastid et al. "Inhibition of CD39 Enzymatic Function at the Surface of Tumor Cells Alleviates their Immunosuppressive Activity" Cancer Immunology Res. 3(3):254-265 (2014).
Batzer et al., "Enhanced evolutionary PCR using oligonucleotides with inosine at the 3'-terminus" Nucleic Acid Res. 19:5081, 1991.
Bensussan, A., et al., "Detection of membrane-bound HLA-G translated products with a specific monoclonal antibody," Proc Natl Acad Sci US A., 92:10292-10296 (1995) 6 / 48.
Berge et al. "Pharmaceutical salts" (1977) J Pharm Sci 66:1-19.
Beyer et al., "Regulatory T cells in cancer", Blood, Aug. 1, 2006, vol. 108, No. 3, pp. 804-811.
Bieg et al. "GAD65 and insulin B chain peptide (9-23) are not primary autoantigens in the type 1 diabetes syndrome of the BB rat" (1999) Autoimmunity 31(1):15-24.
Biological Deposit Receipt for CNCM I-3889.
Biological Deposit Receipt for CNCM I-4171.
Blank et al. "Interaction of PD-L1 on tumor cells with PD-1 on tumor-specific T cells as a mechanism of immune evasion: implications for tumor immunotherapy" (2005) Cancer Immunol. Immunother. 54:307-314.
Blank, C. et al. "Contribution of the PD-L1/PD-1 pathway to T-cell exhaustion: an update on implications for chronic infections and tumor evasion" (Epub Dec. 29, 2006) Immunol. Immunother. 56(5):739-745).
Blay et al., "The extracellular fluid of solid carcinomas contains immunosuppressive concentrations of adenosine" 1997, Cancer Research 57:2602-2605 at Materials and Methods.
Boder et al. "Yeast surface display for directed evolution of protein expression, affinity, and stability" (2000) Methods Enzymology 328:430-444.
Bonnefoy, et al., "CD39: A complementary target to immune checkpoints to counteract tumor-mediated immunosuppression" (2015) OncoImmunology 4(5):e1003015-1-e1003015-3.
Bono, et al., "CD73 and CD39 ectonucleotidases in T cell differentiation: Beyond immunosuppression" (2015) FEBS Letters 589:3454-3460.
Borsellino et al., "Expression of ectonucleotidase CD39 by Foxp3+ Treg cells: hydrolysis of extracellular ATP and immune suppression" (2007) Blood 110:1225-1232.
Bours et al., "P2 receptors and extracellular ATP: a novel homeostatic pathway in inflammation" (2011) Front Biosci (Schol Ed) 3:1443-1456.
Brennan et al., "Preparation of bispecific antibodies by chemical recombination of monoclonal immunoglobulin G1 fragments" (1985) Science 229:81.

(56) References Cited

OTHER PUBLICATIONS

Brinkman et al. "Phage display of disulfide-stabilized Fv fragments" (1995) J Immunol Methods 182:41-50.

Brown et al. "Blockade of programmed death-1 ligands on dendritic cells enhances T cell activation and cytokine production" (2003) J. Immunol. 170:1257-66).

Buffon et al. "NTPDase and 5' ecto-nucleotidase expression profiles and the pattern of extracellular ATP metabolism in the Walker 256 turner" Biochimica et Biophysica Acta 1770:1259-1265 (2007).

Bulavina, L, "Roles of E-NTPDase1 and 5'-eNT in the Regulation of Microglial Phagocytosis" (2013) Doctoral Dissertation, Universitatsmedizen Berlin.

Burton et al. "Human antibodies from combinatorial libraries" (1994) Advances in Immunology 57:191-280.

Burton et al. "Human antibody effector function" (1992) Adv Immun 51:1-18.

Cai, et al., "High expression of CD39 in gastric cancer reduces patient outcome following radical resection" (2016) Oncology Letters 12:4080-4086.

Holland, P. "Targeting the Adenosine Axis to Treat Cancer" Brisbane Immunotherapy Conference May 2019, poster.

Hollinger et al., ""Diabodies": small bivalent and bispecific antibody fragments" (1993) Proc. Natl. Acad. Sci. USA 90:6444-6448.

Hoogenboom "Designing and optimizing library selection strategies for generating high-affinity antibodies" (1997) Trends in Biotechnology 15:62-70.

Horenstein, et al., "A CD38/CD203a/CD73 ectoenzymatic pathway independent of CD39 drives a novel adenosinergic oop in human T lymphocytes" (2013) OncoImmunology 2(9):e26246-1-e26246-14.

Hoskin et al. "Inhibition of T-Cell and Natural Killer cell function by Adenosine and its Contribution to Immune Evasion by Tumor Cells" International Journal of Oncology 32:527-535 (2008).

Hotson/Luke et al., Oral presentation at Society for Immunotherapy of Cancer (SITC) 32nd Annual Meeting (2017) [retrieved on Mar. 13, 2019] Retrieved from the Internet.

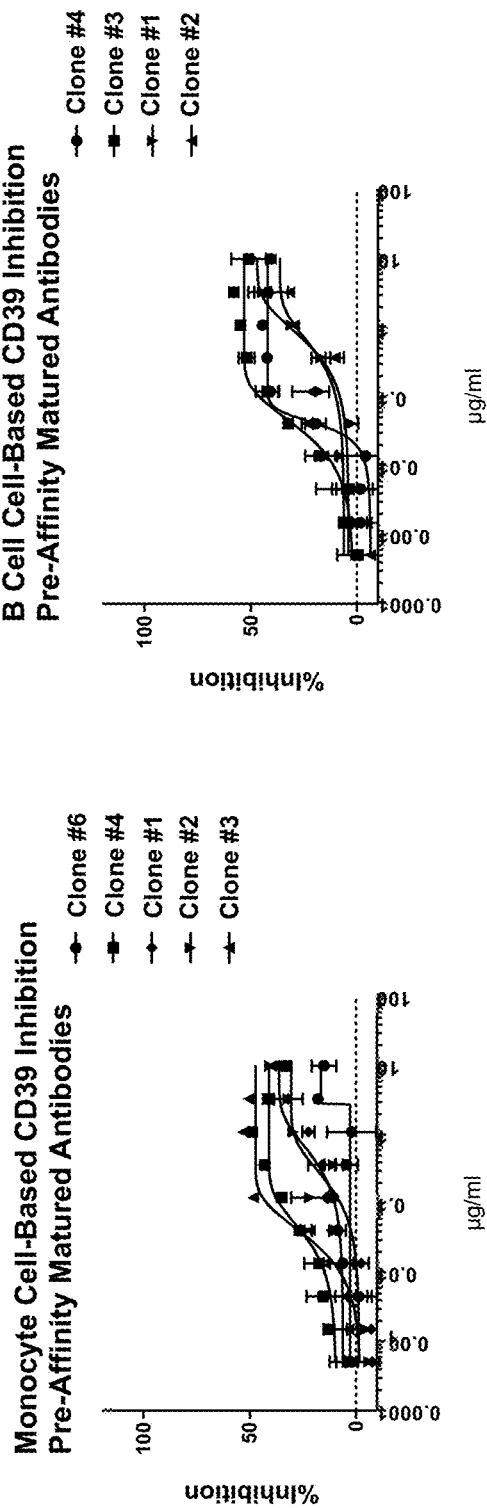
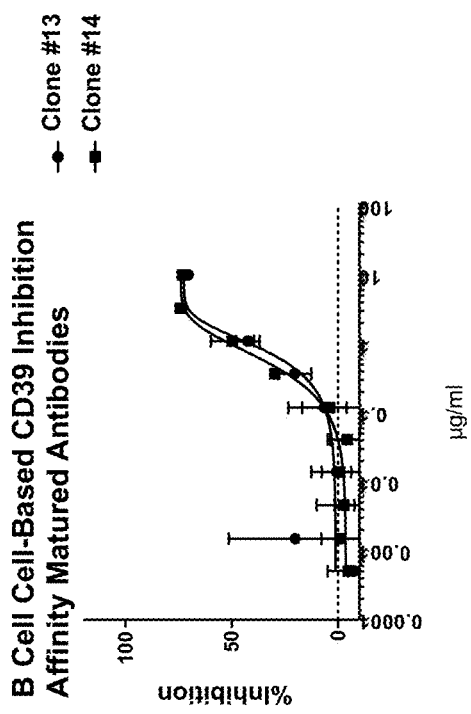
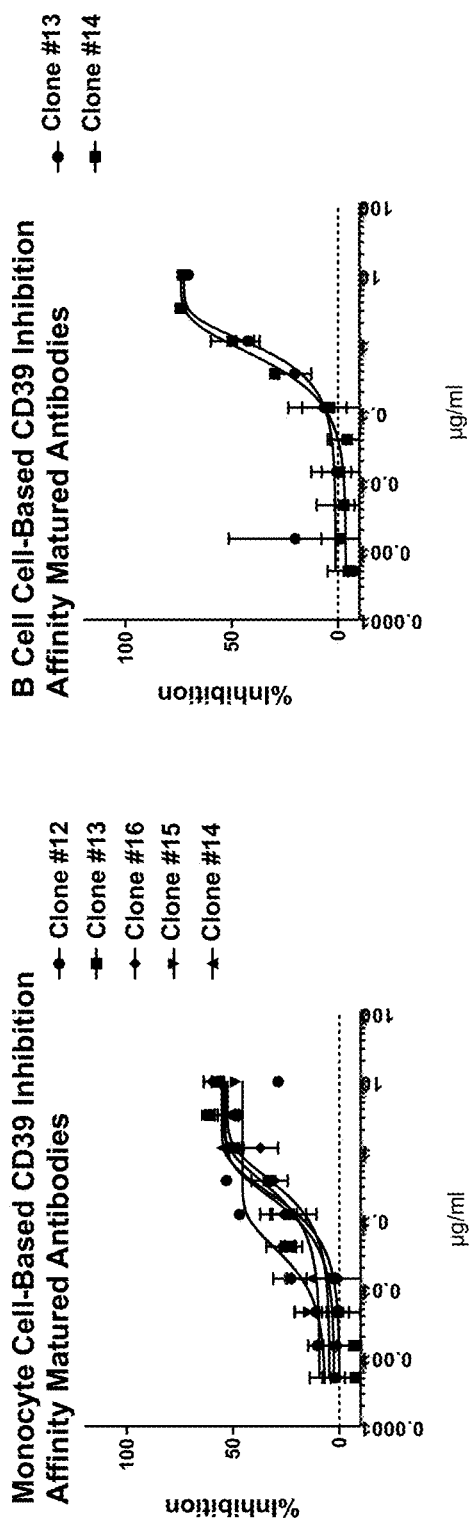

| Antibody | IgG KD Human CD39-His (M) Monovalent |
|---|---|
| Clone #1 | 8.04E-09 |
| Clone #2 | 1.16E-08 |
| Clone #3 | 3.25E-09 |
| Clone #4 | 3.65E-09 |
| Clone #5 | 2.96E-08 |
| Clone #6 | 1.77E-07 |
| Clone #7 | 9.43E-08 |
| Clone #8 | 2.83E-08 |
| Clone #9 | 1.24E-07 |
| Clone #10 | 3.73E-08 |
| Clone #11 | 1.47E-08 |
| Clone #12 | 1.38E-09 |
| Clone #13 | 1.19E-09 |
| Clone #14 | 1.25E-09 |
| Clone #15 | 1.97E-09 |
| Clone #16 | 3.81E-09 |
| Clone #17 | 1.14E-09 |
| Clone #18 | 7.06E-10 |
| Clone #19 | 2.83E-08 |
| Clone #20 | 3.89E-09 |

*Fig. 5A*

| Antibody | MSD Equilibrium KD (M) Biotinylated Human CD39-His incubated with Fab |
|---|---|
| Clone #1 | 2.10E-09 |
| Clone #13 | 1.70E-10 |
| Clone #14 | 1.50E-10 |
| Clone #15 | 3.80E-10 |
| Clone #17 | 9.90E-11 |
| Clone #18 | 3.80E-11 |
| Clone #20 | 6.10E-10 |

*Fig. 5B*

ANTI-CD39 ANTIBODY COMPOSITIONS AND METHODS

This application claims the benefit of priority to U.S. Provisional Application No. 62/901,153, filed Sep. 16, 2019, and U.S. Provisional Application No. 62/902,285, filed Sep. 18, 2019, and U.S. Provisional Application No. 62/932,249, filed Nov. 7, 2019, and U.S. Provisional Application No. 62/935,969, filed Nov. 15, 2019, and U.S. Provisional Application No. 62/975,519, filed Feb. 12, 2020, and U.S. Provisional Application No. 63/003,191, filed Mar. 31, 2020 and U.S. Provisional Application No. 63/075,567, filed Sep. 8, 2020, all of which are incorporated by reference in their entirety.

SEQUENCE LISTING

The instant application contains a Sequence Listing which has been submitted electronically in ASCII format and is hereby incorporated by reference in its entirety. Said ASCII copy, created on Sep. 9, 2020, is named 2020-09-09_01219-0005-00-US_ST25.txt and is 1,641,715 bytes in size.

FIELD OF THE INVENTION

Anti-CD39 antibodies are provided, as well as their use in enhancing, increasing, and sustaining an anti-tumor immune response, reducing the amount of extracellular adenosine in a tumor microenvironment, and treating cancer.

BACKGROUND

The immune system acts through suppressive pathways to prevent cancerous cells from growing. Cancers use various mechanisms to subvert immune suppressive pathways in order to avoid recognition and elimination by immune cells, and to allow disease to progress. Immunotherapies fight cancer by modifying the patient's immune system by either directly stimulating rejection-type processes or by blocking suppressive pathways.

Adenosine is an immunomodulatory metabolite within the tumor microenvironment (TME) that interferes with the immune system's anti-tumor responses. In some cancers, extracellular adenosine accumulates and subsequently inhibits the function of immune cells, including T cells, dendritic cells (DC), and natural killer (NK)-cells, thereby contributing to anti-tumor immune suppression and supporting tumor growth.

The ectonucleotidase CD39 hydrolyzes extracellular adenosine triphosphate (ATP) and adenosine diphosphate (ADP) to generate adenosine monophosphate (AMP), which is then converted to adenosine by CD73. Extracellular adenosine binds to adenosine receptors on immune cells, thereby suppressing the immune system. Overexpression of CD39 is associated with poor prognosis in patients with certain types of cancer. Within the TME, the adenosine pathway refers to the extracellular conversion of ATP to adenosine and the signaling of adenosine through the A2A/A2B adenosine receptors on immune cells. Under normal conditions, CD39 works to maintain the balance of extracellular levels of immunosuppressive adenosine and immunostimulatory ATP. In healthy tissues, ATP is barely detectable in the extracellular environment due to rapid breakdown by CD39 and conversion to adenosine by CD73. Under conditions of cellular stress, including cancer, extracellular ATP levels rise significantly leading to high levels of adenosine, which acts to suppress recognition of the tumor by the immune system and the anti-tumor response.

There continues to be an unmet need for the development of novel cancer therapies. Novel combinations with existing therapies and therapeutic regimens are also needed to more effectively combat various cancers.

I. SUMMARY

In some embodiments, an isolated anti-CD39 antibody is provided. Such an isolated anti-CD39 antibody binds to human CD39, wherein the antibody is optionally fully human or humanized.

In some embodiments, the disclosure provides an isolated antibody comprising:
(a) HCDR1 comprising the amino acid sequence of SEQ ID NO: 1; (b) HCDR2 comprising the amino acid sequence of SEQ ID NO: 2; (c) HCDR3 comprising the amino acid sequence of SEQ ID NO: 3; (d) LCDR1 comprising the amino acid sequence of SEQ ID NO: 4; (e) LCDR2 comprising the amino acid sequence of SEQ ID NO: 5; and (f) LCDR3 comprising the amino acid sequence of SEQ ID NO: 6; or
(a) HCDR1 comprising the amino acid sequence of SEQ ID NO: 101; (b) HCDR2 comprising the amino acid sequence of SEQ ID NO: 102; (c) HCDR3 comprising the amino acid sequence of SEQ ID NO: 103; (d) LCDR1 comprising the amino acid sequence of SEQ ID NO: 104; (e) LCDR2 comprising the amino acid sequence of SEQ ID NO: 105; and (f) LCDR3 comprising the amino acid sequence of SEQ ID NO: 106; or
(a) HCDR1 comprising the amino acid sequence of SEQ ID NO: 201; (b) HCDR2 comprising the amino acid sequence of SEQ ID NO: 202; (c) HCDR3 comprising the amino acid sequence of SEQ ID NO: 203; (d) LCDR1 comprising the amino acid sequence of SEQ ID NO: 204; (e) LCDR2 comprising the amino acid sequence of SEQ ID NO: 205; and (f) LCDR3 comprising the amino acid sequence of SEQ ID NO: 206; or
(a) HCDR1 comprising the amino acid sequence of SEQ ID NO: 301; (b) HCDR2 comprising the amino acid sequence of SEQ ID NO: 302; (c) HCDR3 comprising the amino acid sequence of SEQ ID NO: 303; (d) LCDR1 comprising the amino acid sequence of SEQ ID NO: 304; (e) LCDR2 comprising the amino acid sequence of SEQ ID NO: 305; and (f) LCDR3 comprising the amino acid sequence of SEQ ID NO: 306; or
(a) HCDR1 comprising the amino acid sequence of SEQ ID NO: 401; (b) HCDR2 comprising the amino acid sequence of SEQ ID NO: 402; (c) HCDR3 comprising the amino acid sequence of SEQ ID NO: 403; (d) LCDR1 comprising the amino acid sequence of SEQ ID NO: 404; (e) LCDR2 comprising the amino acid sequence of SEQ ID NO: 405; and (f) LCDR3 comprising the amino acid sequence of SEQ ID NO: 406; or
(a) HCDR1 comprising the amino acid sequence of SEQ ID NO: 501; (b) HCDR2 comprising the amino acid sequence of SEQ ID NO: 502; (c) HCDR3 comprising the amino acid sequence of SEQ ID NO: 503; (d) LCDR1 comprising the amino acid sequence of SEQ ID NO: 504; (e) LCDR2 comprising the amino acid sequence of SEQ ID NO: 505; and (f) LCDR3 comprising the amino acid sequence of SEQ ID NO: 506; or
(a) HCDR1 comprising the amino acid sequence of SEQ ID NO: 601; (b) HCDR2 comprising the amino acid sequence of SEQ ID NO: 602; (c) HCDR3 comprising the amino acid sequence of SEQ ID NO: 603; (d) LCDR1 comprising the amino acid sequence of SEQ ID NO: 604; (e) LCDR2 comprising the amino acid sequence of SEQ ID NO: 605; and (f) LCDR3 comprising the amino acid sequence of SEQ ID NO: 606; or (a) HCDR1 comprising the amino acid sequence of SEQ ID NO: 701; (b) HCDR2 comprising the amino acid sequence of SEQ ID NO: 702; (c) HCDR3 comprising the amino acid sequence of SEQ ID NO: 703; (d) LCDR1 comprising the amino acid sequence of SEQ ID NO: 704; (e) LCDR2 comprising the amino acid sequence of SEQ ID NO: 705; and (f) LCDR3 comprising the amino acid sequence of SEQ ID NO: 706; or (a) HCDR1 comprising the amino acid sequence of SEQ ID NO: 801; (b) HCDR2 comprising the amino acid sequence of SEQ ID NO: 802; (c) HCDR3 comprising the amino acid sequence of SEQ ID NO: 803; (d) LCDR1 comprising the amino acid sequence of SEQ ID NO: 804; (e) LCDR2 comprising the amino acid sequence of SEQ ID NO: 805; and (f) LCDR3 comprising the amino acid sequence of SEQ ID NO: 806; or (a) HCDR1 comprising the amino acid sequence of SEQ ID NO: 901; (b) HCDR2 comprising the amino acid sequence of SEQ ID NO: 902; (c) HCDR3 comprising the amino acid sequence of SEQ ID NO: 903; (d) LCDR1 comprising the amino acid sequence of SEQ ID NO: 904; (e) LCDR2 comprising the amino acid sequence of SEQ ID NO: 905; and (f) LCDR3 comprising the amino acid sequence of SEQ ID NO: 906; or (a) HCDR1 comprising the amino acid sequence of SEQ ID NO: 1001; (b) HCDR2 comprising the amino acid sequence of SEQ ID NO: 1002; (c) HCDR3 comprising the amino acid sequence of SEQ ID NO: 1003; (d) LCDR1 comprising the amino acid sequence of SEQ ID NO: 1004; (e) LCDR2 comprising the amino acid sequence of SEQ ID NO: 1005; and (f) LCDR3 comprising the amino acid sequence of SEQ ID NO: 1006; or (a) HCDR1 comprising the amino acid sequence of SEQ ID NO: 2001; (b) HCDR2 comprising the amino acid sequence of SEQ ID NO: 2002; (c) HCDR3 comprising the amino acid sequence of SEQ ID NO: 2003; (d) LCDR1 comprising the amino acid sequence of SEQ ID NO: 2004; (e) LCDR2 comprising the amino acid sequence of SEQ ID NO: 2005; and (f) LCDR3 comprising the amino acid sequence of SEQ ID NO: 2006; or (a) HCDR1 comprising the amino acid sequence of SEQ ID NO: 3001; (b) HCDR2 comprising the amino acid sequence of SEQ ID NO: 3002; (c) HCDR3 comprising the amino acid sequence of SEQ ID NO: 3003; (d) LCDR1 comprising the amino acid sequence of SEQ ID NO: 3004; (e) LCDR2 comprising the amino acid sequence of SEQ ID NO: 3005; and (f) LCDR3 comprising the amino acid sequence of SEQ ID NO: 3006; or (a) HCDR1 comprising the amino acid sequence of SEQ ID NO: 4001; (b) HCDR2 comprising the amino acid sequence of SEQ ID NO: 4002; (c) HCDR3 comprising the amino acid sequence of SEQ ID NO: 4003; (d) LCDR1 comprising the amino acid sequence of SEQ ID NO: 4004; (e) LCDR2 comprising the amino acid sequence of SEQ ID NO: 4005; and (f) LCDR3 comprising the amino acid sequence of SEQ ID NO: 4006; or (a) HCDR1 comprising the amino acid sequence of SEQ ID NO: 5001; (b) HCDR2 comprising the amino acid sequence of SEQ ID NO: 5002; (c) HCDR3 comprising the amino acid sequence of SEQ ID NO: 5003; (d) LCDR1 comprising the amino acid sequence of SEQ ID NO: 5004; (e) LCDR2 comprising the amino acid sequence of SEQ ID NO: 5005; and (f) LCDR3 comprising the amino acid sequence of SEQ ID NO: 5006; or (a) HCDR1 comprising the amino acid sequence of SEQ ID NO: 6001; (b) HCDR2 comprising the amino acid sequence of SEQ ID NO: 6002; (c) HCDR3 comprising the amino acid sequence of SEQ ID NO: 6003; (d) LCDR1 comprising the amino acid sequence of SEQ ID NO: 6004; (e) LCDR2 comprising the amino acid sequence of SEQ ID NO: 6005; and (f) LCDR3 comprising the amino acid sequence of SEQ ID NO: 6006; or (a) HCDR1 comprising the amino acid sequence of SEQ ID NO: 7001; (b) HCDR2 comprising the amino acid sequence of SEQ ID NO: 7002; (c) HCDR3 comprising the amino acid sequence of SEQ ID NO: 7003; (d) LCDR1 comprising the amino acid sequence of SEQ ID NO: 7004; (e) LCDR2 comprising the amino acid sequence of SEQ ID NO: 7005; and (f) LCDR3 comprising the amino acid sequence of SEQ ID NO: 7006; or (a) HCDR1 comprising the amino acid sequence of SEQ ID NO: 8001; (b) HCDR2 comprising the amino acid sequence of SEQ ID NO: 8002; (c) HCDR3 comprising the amino acid sequence of SEQ ID NO: 8003; (d) LCDR1 comprising the amino acid sequence of SEQ ID NO: 8004; (e) LCDR2 comprising the amino acid sequence of SEQ ID NO: 8005; and (f) LCDR3 comprising the amino acid sequence of SEQ ID NO: 8006; or (a) HCDR1 comprising the amino acid sequence of SEQ ID NO: 9001; (b) HCDR2 comprising the amino acid sequence of SEQ ID NO: 9002; (c) HCDR3 comprising the amino acid sequence of SEQ ID NO: 9003; (d) LCDR1 comprising the amino acid sequence of SEQ ID NO: 9004; (e) LCDR2 comprising the amino acid sequence of SEQ ID NO: 9005; and (f) LCDR3 comprising the amino acid sequence of SEQ ID NO: 9006; or (a) HCDR1 comprising the amino acid sequence of SEQ ID NO: 10001; (b) HCDR2 comprising the amino acid sequence of SEQ ID NO: 10002; (c) HCDR3 comprising the amino acid sequence of SEQ ID NO: 10003; (d) LCDR1 comprising the amino acid sequence of SEQ ID NO: 10004; (e) LCDR2 comprising the amino acid sequence of SEQ ID NO: 10005; and (f) LCDR3 comprising the amino acid sequence of SEQ ID NO: 10006; or (a) HCDR1 comprising the amino acid sequence of SEQ ID NO: 20001; (b) HCDR2 comprising the amino acid sequence of SEQ ID NO: 20002; (c) HCDR3 comprising the amino acid sequence of SEQ ID NO: 20003; (d) LCDR1 comprising the amino acid sequence of SEQ ID NO: 20004; (e) LCDR2 comprising the amino acid sequence of SEQ ID NO: 20005; and (f) LCDR3 comprising the amino acid sequence of SEQ ID NO: 20006; or (a) HCDR1 comprising the amino acid sequence of SEQ ID NO: 30001; (b) HCDR2 comprising the amino acid sequence of SEQ ID NO: 30002; (c) HCDR3 comprising the amino acid sequence of SEQ ID NO: 30003; (d) LCDR1 comprising the amino acid sequence of SEQ ID NO: 30004; (e) LCDR2 comprising the amino acid sequence of SEQ ID NO: 30005; and (f) LCDR3 comprising the amino acid sequence of SEQ ID NO: 30006.

In some embodiments, the antibody comprises a heavy chain variable region (VH) and a light chain variable region (VL), wherein:

the VH is at least 90%, 91%, 92%, 93%, 94%, 95%, 96%, 97%, 98%, 99%, or 100% identical to the amino acid sequence of SEQ ID NO: 12 and the VL is at least 90%, 91%, 92%, 93%, 94%, 95%, 96%, 97%, 98%, 99%, or 100% identical to the amino acid sequence of SEQ ID NO: 18; or the VH is at least 90%, 91%, 92%, 93%, 94%, 95%, 96%, 97%, 98%, 99%, or 100% identical to the amino acid sequence of SEQ ID NO: 112 and the VL is at least 90%, 91%, 92%, 93%, 94%, 95%, 96%, 97%, 98%, 99%, or 100% identical to the amino acid sequence of SEQ ID NO: 118; or the VH is at least 90%, 91%, 92%, 93%, 94%, 95%, 96%, 97%, 98%, 99%, or 100% identical to the amino acid sequence of SEQ ID NO: 212 and the VL is at least 90%, 91%, 92%, 93%, 94%, 95%, 96%, 97%, 98%, 99%, or 100% identical to the amino acid sequence of SEQ ID NO: 218; or the VH is at least 90%, 91%, 92%, 93%, 94%, 95%, 96%, 97%, 98%, 99%, or 100% identical to the amino acid sequence of SEQ ID NO: 312 and the VL is at least 90%, 91%, 92%, 93%, 94%, 95%, 96%, 97%, 98%, 99%, or 100% identical to the amino acid sequence of SEQ ID NO: 318; or the VH is at least 90%, 91%, 92%, 93%, 94%, 95%, 96%, 97%, 98%, 99%, or 100% identical to the amino acid sequence of SEQ ID NO: 412 and the VL is at least 90%, 91%, 92%, 93%, 94%, 95%, 96%, 97%, 98%, 99%, or 100% identical to the amino acid sequence of SEQ ID NO: 418; or the VH is at least 90%, 91%, 92%, 93%, 94%, 95%, 96%, 97%, 98%, 99%, or 100% identical to the amino acid sequence of SEQ ID NO: 512 and the VL is at least 90%, 91%, 92%, 93%, 94%, 95%, 96%, 97%, 98%, 99%, or 100% identical to the amino acid sequence of SEQ ID NO: 518; or the VH is at least 90%, 91%, 92%, 93%, 94%, 95%, 96%, 97%, 98%, 99%, or 100% identical to the amino acid sequence of SEQ ID NO: 612 and the VL is at least 90%, 91%, 92%, 93%, 94%, 95%, 96%, 97%, 98%, 99%, or 100% identical to the amino acid sequence of SEQ ID NO: 618; or the VH is at least 90%, 91%, 92%, 93%, 94%, 95%, 96%, 97%, 98%, 99%, or 100% identical to the amino acid sequence of SEQ ID NO: 712 and the VL is at least 90%, 91%, 92%, 93%, 94%, 95%, 96%, 97%, 98%, 99%, or 100% identical to the amino acid sequence of SEQ ID NO: 718; or the VH is at least 90%, 91%, 92%, 93%, 94%, 95%, 96%, 97%, 98%, 99%, or 100% identical to the amino acid sequence of SEQ ID NO: 812 and the VL is at least 90%, 91%, 92%, 93%, 94%, 95%, 96%, 97%, 98%, 99%, or 100% identical to the amino acid sequence of SEQ ID NO: 818; or the VH is at least 90%, 91%, 92%, 93%, 94%, 95%, 96%, 97%, 98%, 99%, or 100% identical to the amino acid sequence of SEQ ID NO: 912 and the VL is at least 90%, 91%, 92%, 93%, 94%, 95%, 96%, 97%, 98%, 99%, or 100% identical to the amino acid sequence of SEQ ID NO: 918; or the VH is at least 90%, 91%, 92%, 93%, 94%, 95%, 96%, 97%, 98%, 99%, or 100% identical to the amino acid sequence of SEQ ID NO: 1012 and the VL is at least 90%, 91%, 92%, 93%, 94%, 95%, 96%, 97%, 98%, 99%, or 100% identical to the amino acid sequence of SEQ ID NO: 1018; or the VH is at least 90%, 91%, 92%, 93%, 94%, 95%, 96%, 97%, 98%, 99%, or 100% identical to the amino acid sequence of SEQ ID NO: 2012 and the VL is at least 90%, 91%, 92%, 93%, 94%, 95%, 96%, 97%, 98%, 99%, or 100% identical to the amino acid sequence of SEQ ID NO: 2018; or the VH is at least 90%, 91%, 92%, 93%, 94%, 95%, 96%, 97%, 98%, 99%, or 100% identical to the amino acid sequence of SEQ ID NO: 3012 and the VL is at least 90%, 91%, 92%, 93%, 94%, 95%, 96%, 97%, 98%, 99%, or 100% identical to the amino acid sequence of SEQ ID NO: 3018; or the VH is at least 90%, 91%, 92%, 93%, 94%, 95%, 96%, 97%, 98%, 99%, or 100% identical to the amino acid sequence of SEQ ID NO: 4012 and the VL is at least 90%, 91%, 92%, 93%, 94%, 95%, 96%, 97%, 98%, 99%, or 100% identical to the amino acid sequence of SEQ ID NO: 4018; or the VH is at least 90%, 91%, 92%, 93%, 94%, 95%, 96%, 97%, 98%, 99%, or 100% identical to the amino acid sequence of SEQ ID NO: 5012 and the VL is at least 90%, 91%, 92%, 93%, 94%, 95%, 96%, 97%, 98%, 99%, or 100% identical to the amino acid sequence of SEQ ID NO: 5018; or the VH is at least 90%, 91%, 92%, 93%, 94%, 95%, 96%, 97%, 98%, 99%, or 100% identical to the amino acid sequence of SEQ ID NO: 6012 and the VL is at least 90%, 91%, 92%, 93%, 94%, 95%, 96%, 97%, 98%, 99%, or 100% identical to the amino acid sequence of SEQ ID NO: 6018; or the VH is at least 90%, 91%, 92%, 93%, 94%, 95%, 96%, 97%, 98%, 99%, or 100% identical to the amino acid sequence of SEQ ID NO: 7012 and the VL is at least 90%, 91%, 92%, 93%, 94%, 95%, 96%, 97%, 98%, 99%, or 100% identical to the amino acid sequence of SEQ ID NO: 7018; or the VH is at least 90%, 91%, 92%, 93%, 94%, 95%, 96%, 97%, 98%, 99%, or 100% identical to the amino acid sequence of SEQ ID NO: 8012 and the VL is at least 90%, 91%, 92%, 93%, 94%, 95%, 96%, 97%, 98%, 99%, or 100% identical to the amino acid sequence of SEQ ID NO: 8018; or the VH is at least 90%, 91%, 92%, 93%, 94%, 95%, 96%, 97%, 98%, 99%, or 100% identical to the amino acid sequence of SEQ ID NO: 9012 and the VL is at least 90%, 91%, 92%, 93%, 94%, 95%, 96%, 97%, 98%, 99%, or 100% identical to the amino acid sequence of SEQ ID NO: 9018; or the VH is at least 90%, 91%, 92%, 93%, 94%, 95%, 96%, 97%, 98%, 99%, or 100% identical to the amino acid sequence of SEQ ID NO: 10012 and the VL is at least 90%, 91%, 92%, 93%, 94%, 95%, 96%, 97%, 98%, 99%, or 100% identical to the amino acid sequence of SEQ ID NO: 10018; or the VH is at least 90%, 91%, 92%, 93%, 94%, 95%, 96%, 97%, 98%, 99%, or 100% identical to the amino acid sequence of SEQ ID NO: 20012 and the VL is at least 90%, 91%, 92%, 93%, 94%, 95%, 96%, 97%, 98%, 99%, or 100% identical to the amino acid sequence of SEQ ID NO: 20018; or the VH is at least 90%, 91%, 92%, 93%, 94%, 95%, 96%, 97%, 98%, 99%, or 100% identical to the amino acid sequence of SEQ ID NO: 30012 and the VL is at least 90%, 91%, 92%, 93%, 94%, 95%, 96%, 97%, 98%, 99%, or 100% identical to the amino acid sequence of SEQ ID NO: 30018.

In some embodiments, the antibody comprises six CDRs (HCDR1, HCDR2, HCDR3, LCDR1, LCDR2, and LCDR3) as described herein, and VH and/or VL sequences that are at least 90%, 91%, 92%, 93%, 94%, 95%, 96%, 97%, 98%, 99%, or 100% identical to VH and/or VL amino acid sequence described herein. In some embodiments, the VH and/or VL sequences are not 100% identical to an amino acid sequence described herein. In some embodiments, the antibody comprises HCDR1, HCDR2, HCDR3, LCDR1, LCDR2, and LCDR3 amino acid sequences described herein, and sequence variation within the VH and/or VL sequences that is outside of the CDR sequences. In such embodiments, the sequence variation of the VH and/or VL sequences is within one or more framework regions of the VH and/or VL.

In some embodiments, the antibody comprises VH and/or VL sequences that are at least 90%, 91%, 92%, 93%, 94%, 95%, 96%, 97%, 98%, 99%, or 100% identical to an amino acid sequence described herein. In some embodiments, the VH and/or VL sequences are not 100% identical to an amino acid described herein. In such embodiments, the sequence variation of the VH and/or VL sequences is within and/or outside of the CDR sequences, unless otherwise specified.

In some embodiments, the antibody comprises a heavy chain variable region (VH) and a light chain variable region (VL), wherein:
the VH comprises the amino acid sequence of SEQ ID NO: 12 and the VL comprises the amino acid sequence of SEQ ID NO: 18; or
the VH comprises the amino acid sequence of SEQ ID NO: 112 and the VL comprises the amino acid sequence of SEQ ID NO: 118; or
the VH comprises the amino acid sequence of SEQ ID NO: 212 and the VL comprises the amino acid sequence of SEQ ID NO: 218; or
the VH comprises the amino acid sequence of SEQ ID NO: 312 and the VL comprises the amino acid sequence of SEQ ID NO: 318; or
the VH comprises the amino acid sequence of SEQ ID NO: 412 and the VL comprises the amino acid sequence of SEQ ID NO: 418; or
the VH comprises the amino acid sequence of SEQ ID NO: 512 and the VL comprises the amino acid sequence of SEQ ID NO: 518; or
the VH comprises the amino acid sequence of SEQ ID NO: 612 and the VL comprises the amino acid sequence of SEQ ID NO: 618; or
the VH comprises the amino acid sequence of SEQ ID NO: 712 and the VL comprises the amino acid sequence of SEQ ID NO: 718; or
the VH comprises the amino acid sequence of SEQ ID NO: 812 and the VL comprises the amino acid sequence of SEQ ID NO: 818; or
the VH comprises the amino acid sequence of SEQ ID NO: 912 and the VL comprises the amino acid sequence of SEQ ID NO: 918; or
the VH comprises the amino acid sequence of SEQ ID NO: 1012 and the VL comprises the amino acid sequence of SEQ ID NO: 1018; or
the VH comprises the amino acid sequence of SEQ ID NO: 2012 and the VL comprises the amino acid sequence of SEQ ID NO: 2018; or
the VH comprises the amino acid sequence of SEQ ID NO: 3012 and the VL comprises the amino acid sequence of SEQ ID NO: 3018; or
the VH comprises the amino acid sequence of SEQ ID NO: 4012 and the VL comprises the amino acid sequence of SEQ ID NO: 4018; or
the VH comprises the amino acid sequence of SEQ ID NO: 5012 and the VL comprises the amino acid sequence of SEQ ID NO: 5018; or
the VH comprises the amino acid sequence of SEQ ID NO: 6012 and the VL comprises the amino acid sequence of SEQ ID NO: 6018; or
the VH comprises the amino acid sequence of SEQ ID NO: 7012 and the VL comprises the amino acid sequence of SEQ ID NO: 7018; or
the VH comprises the amino acid sequence of SEQ ID NO: 8012 and the VL comprises the amino acid sequence of SEQ ID NO: 8018; or
the VH comprises the amino acid sequence of SEQ ID NO: 9012 and the VL comprises the amino acid sequence of SEQ ID NO: 9018; or
the VH comprises the amino acid sequence of SEQ ID NO: 10012 and the VL comprises the amino acid sequence of SEQ ID NO: 10018; or
the VH comprises the amino acid sequence of SEQ ID NO: 20012 and the VL comprises the amino acid sequence of SEQ ID NO: 20018; or
the VH comprises the amino acid sequence of SEQ ID NO: 30012 and the VL comprises the amino acid sequence of SEQ ID NO: 30018.

In some embodiments, the antibody is clone 1, 2, 3, 4, 5, 6, 7, 8, 9, 10, 11, 12, 13, 14, 15, 16, 17, 18, 19, 20, 21, or 22 or a CD39 binding fragment thereof. In some embodiments, the antibody is clone 22.

In some embodiments, the antibody is a monoclonal antibody. In some embodiments, the antibody is a humanized antibody. In some embodiments, the antibody is a fully human antibody. In some embodiments, the antibody is an antibody fragment, wherein the antibody fragment binds CD39. In some embodiments, the antibody is an antibody fragment selected from a Fab, Fab', Fv, scFv or (Fab')$_2$. In some embodiments, the antibody is a full-length antibody. In some embodiments, the isolated antibody comprises an IgG1, IgG2, IgG3, or IgG4 Fc region. In some embodiments, the antibody comprises a human IgG1 heavy chain constant region. In some embodiments, the antibody comprises a human IgG4 heavy chain constant region. In some embodiments, the antibody comprises a mutant human IgG4 heavy chain constant region. In some embodiments, the mutant IgG4 constant region comprises a mutation selected from a substitution at Ser228, a substitution at Leu235, a substitution at Asn297, or a combination thereof, numbering according to EU numbering. In some embodiments, the mutant IgG4 heavy chain constant region comprises an S228P substitution. In some embodiments, the antibody comprises the heavy chain constant region of SEQ ID NO: 40002. In some embodiments, the antibody comprises the heavy chain constant region of SEQ ID NO: 40003. In some embodiments, the antibody comprises a human kappa light chain.

In some embodiments, the disclosure provides a composition comprising an antibody disclosed herein and a pharmaceutically acceptable carrier.

In some embodiments, the antibody binds to and inhibits CD39. In some embodiments, the antibody reduces or inhibits the enzymatic activity of human CD39. In some embodiments, the antibody binds to recombinant CD39 and/or to membrane bound human CD39. In some embodiments, the antibody binds to human CD39 with an equilibrium dissociation constant ($K_D$) of less than 10 nM. In some embodiments, the $K_D$ for binding to human CD39 is about 1.11 nM. In some embodiments, the antibody binds to human CD39 and cynomolgus monkey CD39 but does not bind to mouse CD39 or rat CD39. In some embodiments, the antibody inhibits or reduces conversion by human CD39 of extracellular adenosine triphosphate (eATP) or extracellular adenosine diphosphate (eADP) to extracellular adenosine monophosphate (eAMP). In some embodiments, the antibody increases the amount of eATP. In some embodiments, the antibody reduces or decreases the amount of extracellular adenosine. In some embodiments, the antibody maintains, increases or enhances an immunostimulatory level of eATP. In some embodiments, the antibody antagonizes human CD39 in a tumor microenvironment of a tissue. In some embodiments, the antibody cross-reacts with cynomolgus CD39. In some embodiments, the antibody increases or enhances proliferation of a lymphocyte. In some embodiments, the antibody increases or enhances macrophage infiltration in tumors. In some embodiments, the antibody binds to CD39 and inhibits CD39 within a normal or cancerous tissue. In some embodiments, the tissue is in the uterus, cervix, lung, prostate, breast, head, neck, colon, or ovary. In some embodiments, the tissue is in the uterus. In some embodiments, within the uterus, the antibody inhibits CD39 in the myometrium.

In some embodiments, a method of inhibiting CD39 activity in tissue is provided, wherein the antibody comprises (a) HCDR1 comprising the amino acid sequence of SEQ ID NO: 30001; (b) HCDR2 comprising the amino acid sequence of SEQ ID NO: 30002; (c) HCDR3 comprising the amino acid sequence of SEQ ID NO: 30003; (d) LCDR1 comprising the amino acid sequence of SEQ ID NO: 30004; (e) LCDR2 comprising the amino acid sequence of SEQ ID NO: 30005; and (f) LCDR3 comprising the amino acid sequence of SEQ ID NO: 30006. In some embodiments, the antibody inhibiting CD39 activity in the tissue comprises a variable heavy chain of SEQ ID NO: 30012 and a variable light chain of SEQ ID NO: 30018. In some embodiments, the antibody inhibiting CD39 activity in tissue comprises the heavy chain of SEQ ID NO: 30019. In some embodiments, the antibody inhibiting CD39 activity in tissue comprises the light chain of 30021. In some embodiments, the antibody inhibiting CD39 activity in tissue comprises the heavy chain of SEQ ID NO: 30019 and the light chain of 30021. In some embodiments, the antibody inhibiting CD39 activity in the tissue is clone 22.

In some embodiments, the disclosure provides a method of enhancing, increasing and/or sustaining an anti-tumor immune response in a subject comprising administering the antibody or composition described herein to a subject having a tumor.

In some embodiments, the disclosure provides a method of treating cancer in a subject comprising administering the antibody or composition described herein to a subject having cancer. In some embodiments, the disclosure provides a method of inhibiting CD39 in a tissue of a subject having cancer comprising administering the antibody or composition described herein, wherein the administration reduces CD39 activity or total amount of CD39 in the tissue as compared to the activity or amount prior to administration. In some embodiments, the disclosure provides a method of preventing CD39-mediated conversion of eATP and eADP to extracellular adenosine in a tissue of a subject having cancer comprising administering the antibody or composition described herein, wherein the administration reduces extracellular adenosine levels within the tumor microenvironment of the tissue. In some embodiments, the disclosure provides a method of inhibiting CD39 activity in a tissue of a subject having cancer comprising administering the antibody or composition described herein, wherein the administration improves the ability to mount an immune response against a tumor cell.

In some embodiments, the cancer is carcinoma, lymphoma, blastoma, sarcoma, or leukemia. In some embodiments, the cancer is squamous cell cancer, small-cell lung cancer, pituitary cancer, esophageal cancer, astrocytoma, soft tissue sarcoma, non-small cell lung cancer (including squamous cell non-small cell lung cancer), adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, renal cell carcinoma, liver cancer, prostate cancer, vulval cancer, thyroid cancer, hepatic carcinoma, brain cancer, endometrial cancer, testis cancer, cholangiocarcinoma, gallbladder carcinoma, gastric cancer, melanoma, or various types of head and neck cancer (including squamous cell carcinoma of the head and neck). In some embodiments, the cancer is pancreatic cancer. In some embodiments, the cancer is gastric cancer. In some embodiments, the cancer is prostate cancer. In some embodiments, the cancer is endometrial cancer. In some embodiments, the cancer is non-small cell lung cancer. In some embodiments, the cancer is colorectal cancer. In some embodiments, the cancer is ovarian cancer.

In some embodiments, the cancer is advanced. In some embodiments, the cancer is relapsed. In some embodiments, the cancer is refractory. In some embodiments, the cancer is metastatic. In some embodiments, the cancer is a solid tumor. In some embodiments, the cancer is an advanced solid tumor. In some embodiments, the cancer is a relapsed solid tumor. In some embodiments the cancer is a refractory solid tumor. In some embodiments, the cancer is a metastatic solid tumor. In some embodiments, the cancer is an advanced, and/or relapsed, and/or refractory, and/or metastatic solid tumor.

In some embodiments, the subject having cancer has experienced disease progression during or after standard therapy. In some embodiments, the subject having cancer was intolerant of standard therapy. In some embodiments, the subject having cancer does not have appropriate therapies available to them based on the judgment of the investigator.

In some embodiments, the methods described herein further comprise administering a second therapy. In some embodiments, the second therapy is radiotherapy, surgery or administration of a second agent. In some embodiments, the second therapy is administration of a chemotherapy, an opsonizing agent, or a regulatory T cell depleting agent. In some embodiments, the second therapy is a targeted anti-cancer therapy, an oncolytic drug, a cytotoxic agent, an immune-based therapy, a cytokine, an activator of a costimulatory molecule, an inhibitor of an inhibitory molecule, a vaccine, or a cellular immunotherapy, or a combination thereof. In some such embodiments, the second therapy is an antagonist of PD-1, PD-L1, CTLA-4, Lag-3, TIM-3, an adenosine A2A receptor (A2AR) antagonist, an adenosine A2B receptor (A2BR) antagonist, a dual A2AR/A2BR antagonist, a CD40 inhibitor, a CD73 inhibitor, a chimeric antigen receptor (CAR) cell therapy, or a combination thereof. In some embodiments, the second therapy is an antagonist of PD-1. In some embodiments, the second therapy is an antagonist of PD-L1. In some embodiments, the second therapy is an antagonist of CTLA-4. In some embodiments, the second therapy is an antagonist of Lag-3. In some embodiment, the second therapy is an antagonist of TIM-3. In some embodiments, the second therapy is an adenosine A2AR antagonist. In some embodiments, the second therapy is an adenosine A2BR antagonist. In some embodiments, the second therapy is an A2AR/A2BR dual antagonist. In some embodiments, the second therapy is a CD40 inhibitor. In some embodiments, the second therapy is a CD73 inhibitor. In some embodiments, the second therapy is a chimeric antigen receptor (CAR) cell therapy. In some embodiments, the second therapy is an antagonist of TIGIT, CD112R, or CD96, or a combination thereof. In some embodiments, the second therapy is an antagonist of TIGIT. In some embodiments, the second therapy is an antagonist of CD112R. In some embodiments, the second therapy is an antagonist of CD96. In some embodiments, the second therapy is an antagonist of PVRL1, PVRL2, PVRL3, PVRL4, or CD155, or combinations thereof. In some embodiments, the second therapy is an antagonist of PVRL1. In some embodiments, the second therapy is an antagonist of PVRL2. In some embodiments, the second therapy is an antagonist of PVRL3. In some embodiments, the second therapy is an antagonist of PVRL4. In some embodiments, the second therapy is an antagonist of CD155. In some embodiments, the second therapy is an antagonist of CD47, or an antagonist of the cytokine IL-27, or a combination thereof. In some embodiments, the second agent is a pro-inflammatory cytokine, an agonist of a pro-inflammatory cytokine or a cytokine fusion (e.g. NKTR-214, an IL-15 agonist). In some embodiments, the second therapy is an antagonist of CD47. In some embodiments, the second therapy is an antagonist of IL-27. In some embodiments, the second therapy is a STING agonist. In some embodiments, the one or more additional therapies is an anthracycline. In some embodiments, the anthracycline is selected from doxorubicin, daunorubicin, epirubicin, idarubicin, and valrubicin. In some embodiments, the anthracycline is doxorubicin. In some embodiments, the antagonist is an antibody. In some embodiments, the second therapy is gemcitabine and paclitaxel (including albumin-bound paclitaxel). In some embodiments, the second therapy is pembrolizumab. In other embodiments, the second therapy is an A2AR antagonist, an A2BR antagonist, or a dual A2AR/A2BR antagonist.

In some embodiments, the methods described herein further comprise administering a second therapy, wherein the second therapy is an antagonist of CD47. In some embodiments, the antagonist of CD47 is an anti-CD47 antibody. In some embodiments, the anti-CD47 antibody comprises a heavy chain variable region (VH) and a light chain variable region (VL), wherein the VH comprises the amino acid sequence of SEQ ID NO: 40004 and the VL comprises the amino acid sequence of SEQ ID NO: 40005. In some embodiments, the anti-CD47 antibody comprises: (a) HCDR1 comprising the amino acid sequence of SEQ ID NO: 40006; (b) HCDR2 comprising the amino acid sequence of SEQ ID NO: 40007; (c) HCDR3 comprising the amino acid sequence of SEQ ID NO: 40008; (d) LCDR1 comprising the amino acid sequence of SEQ ID NO: 40009; (e) LCDR2 comprising the amino acid sequence of SEQ ID NOL 40010; and (f) LCDR3 comprising the amino acid sequence of SEQ ID NO: 40011.

In some embodiments, the methods described herein further comprise administering a CD39 antibody, a second therapy, and a third therapy, also referred to herein as a triple-combination of cancer therapies. In some embodiments, the triple-combination of cancer therapies comprises an anti-CD39 antibody, a chemotherapeutic agent and an antagonist of PD-1. In some embodiments, the triple-combination of cancer therapies comprises an anti-CD39 antibody, a chemotherapeutic agent and an antagonist of PD-L1. In some embodiments, the triple-combination of cancer therapies comprises an anti-CD39 antibody, an agent targeting the adenosine axis (e.g. a CD73 inhibitor or a A2AR, A2BR or dual A2AR/A2BR antagonist), and an antagonist of PD-1. In some embodiments, the triple-combination of cancer therapies comprises an anti-CD39 antibody, an agent targeting the adenosine axis (e.g. a CD73 inhibitor or a A2AR, A2BR or dual A2AR/A2BR antagonist), and an antagonist of PD-L1. In some embodiments, the triple-combination of cancer therapies comprises an anti-CD39 antibody, a CD73 inhibitor and an antagonist of PD-1. In some embodiments, the triple-combination of cancer therapies comprises an anti-CD39 antibody, a CD73 inhibitor and an antagonist of PD-L1. In some embodiments, the triple-combination of cancer therapies comprises an anti-CD39 antibody, an A2AR, A2BR or dual A2AR/A2BR antagonist and an antagonist of PD-1. In some embodiments, the triple-combination of cancer therapies comprises an anti-CD39 antibody, an A2AR, A2BR or dual A2AR/A2BR antagonist and an antagonist of PD-L1. In some embodiments, the triple-combination of cancer therapies comprises an anti-CD39 antibody, an agent targeting the adenosine axis (e.g. a CD73 inhibitor or A2AR, A2BR or dual A2AR/A2BR antagonist), and a chemotherapeutic agent. In some embodiments, the triple-combination of cancer therapies comprises an anti-CD39 antibody, a CD73 inhibitor and a chemotherapeutic agent. In some embodiments, the triple-combination of cancer therapies comprises an anti-CD39 antibody, an A2AR, A2BR or dual A2AR/A2BR antagonist, and a chemotherapeutic agent.

In some embodiments, the disclosure provides use of the antibody or the composition described herein for enhancing, and/or increasing and/or sustaining an anti-tumor immune response, and/or treating cancer.

In some embodiments, the disclosure provides use of the antibody or the composition described herein in the preparation of a medicament for enhancing, and/or increasing and/or sustaining an anti-tumor immune response, and/or treating cancer.

In some embodiments, the disclosure provides a nucleic acid encoding an antibody disclosed herein.

In some embodiments, the disclosure provides a host cell comprising a nucleic acid encoding an antibody disclosed herein.

In some embodiments, the disclosure provides a method of producing an antibody disclosed herein comprising culturing host cell comprising a nucleic acid encoding an antibody disclosed herein, the host cell being cultured under conditions wherein the antibody is expressed. In some embodiments, the method further comprises purifying the antibody.

In some embodiments, the disclosure provides a kit comprising an antibody or composition disclosed herein, the nucleic acid encoding an antibody disclosed herein, the host cell comprising a nucleic acid encoding an antibody disclosed herein, or any combination thereof.

Exemplary embodiments of the disclosure include the following:
  Embodiment 1. An isolated anti-CD39 antibody which binds to human CD39, wherein the antibody is optionally fully human or humanized.
  Embodiment 2. The isolated antibody of embodiment 1, wherein the isolated antibody comprises:
    i) (a) HCDR1 comprising the amino acid sequence of SEQ ID NO: 1; (b) HCDR2 comprising the amino acid sequence of SEQ ID NO: 2; (c) HCDR3 comprising the amino acid sequence of SEQ ID NO: 3; (d) LCDR1 comprising the amino acid sequence of SEQ ID NO: 4; (e) LCDR2 comprising the amino acid sequence of SEQ ID NO: 5; and (f) LCDR3 comprising the amino acid sequence of SEQ ID NO: 6; or ii) (a) HCDR1 comprising the amino acid sequence of SEQ ID NO: 101; (b) HCDR2 comprising the amino acid sequence of SEQ ID NO: 102; (c) HCDR3 comprising the amino acid sequence of SEQ ID NO: 103; (d) LCDR1 comprising the amino acid sequence of SEQ ID NO: 104; (e) LCDR2 comprising the amino acid sequence of SEQ ID NO: 105; and (f) LCDR3 comprising the amino acid sequence of SEQ ID NO: 106; or iii) (a) HCDR1 comprising the amino acid sequence of SEQ ID NO: 201; (b) HCDR2 comprising the amino acid sequence of SEQ ID NO: 202; (c) HCDR3 comprising the amino acid sequence of SEQ ID NO: 203; (d) LCDR1 comprising the amino acid sequence of SEQ ID NO: 204; (e) LCDR2 comprising the amino acid sequence of SEQ ID NO: 205; and (f) LCDR3 comprising the amino acid sequence of SEQ ID NO: 206; or iv) (a) HCDR1 comprising the amino acid sequence of SEQ ID NO: 301; (b) HCDR2 comprising the amino acid sequence of SEQ ID NO: 302; (c) HCDR3 comprising the amino acid sequence of SEQ ID NO: 303; (d) LCDR1 comprising the amino acid sequence of SEQ ID NO: 304; (e) LCDR2 comprising the amino acid sequence of SEQ ID NO: 305; and (f) LCDR3 comprising the amino acid sequence of SEQ ID NO: 306; or v) (a) HCDR1 comprising the amino acid sequence of SEQ ID NO: 401; (b) HCDR2 comprising the amino acid sequence of SEQ ID NO: 402; (c) HCDR3 comprising the amino acid sequence of SEQ ID NO: 403; (d) LCDR1 comprising the amino acid sequence of SEQ ID NO: 404; (e) LCDR2 comprising the amino acid sequence of SEQ ID NO: 405; and (f) LCDR3 comprising the amino acid sequence of SEQ ID NO: 406; or vi) (a) HCDR1 comprising the amino acid sequence of SEQ ID NO: 501; (b) HCDR2 comprising the amino acid sequence of SEQ ID NO: 502; (c) HCDR3 comprising the amino acid sequence of SEQ ID NO: 503; (d) LCDR1 comprising the amino acid sequence of SEQ ID NO: 504; (e) LCDR2 comprising the amino acid sequence of SEQ ID NO: 505; and (f) LCDR3 comprising the amino acid sequence of SEQ ID NO: 506; or vii) (a) HCDR1 comprising the amino acid sequence of SEQ ID NO: 601; (b) HCDR2 comprising the amino acid sequence of SEQ ID NO: 602; (c) HCDR3 comprising the amino acid sequence of SEQ ID NO: 603; (d) LCDR1 comprising the amino acid sequence of SEQ ID NO: 604; (e) LCDR2 comprising the amino acid sequence of SEQ ID NO: 605; and (f) LCDR3 comprising the amino acid sequence of SEQ ID NO: 606; or viii) (a) HCDR1 comprising the amino acid sequence of SEQ ID NO: 701; (b) HCDR2 comprising the amino acid sequence of SEQ ID NO: 702; (c) HCDR3 comprising the amino acid sequence of SEQ ID NO: 703; (d) LCDR1 comprising the amino acid sequence of SEQ ID NO: 704; (e) LCDR2 comprising the amino acid sequence of SEQ ID NO: 705; and (f) LCDR3 comprising the amino acid sequence of SEQ ID NO: 706; or ix) (a) HCDR1 comprising the amino acid sequence of SEQ ID NO: 801; (b) HCDR2 comprising the amino acid sequence of SEQ ID NO: 802; (c) HCDR3 comprising the amino acid sequence of SEQ ID NO: 803; (d) LCDR1 comprising the amino acid sequence of SEQ ID NO: 804; (e) LCDR2 comprising the amino acid sequence of SEQ ID NO: 805; and (f) LCDR3 comprising the amino acid sequence of SEQ ID NO: 806; or x) (a) HCDR1 comprising the amino acid sequence of SEQ ID NO: 901; (b) HCDR2 comprising the amino acid sequence of SEQ ID NO: 902; (c) HCDR3 comprising the amino acid sequence of SEQ ID NO: 903; (d) LCDR1 comprising the amino acid sequence of SEQ ID NO: 904; (e) LCDR2 comprising the amino acid sequence of SEQ ID NO: 905; and (f) LCDR3 comprising the amino acid sequence of SEQ ID NO: 906; or xi) (a) HCDR1 comprising the amino acid sequence of SEQ ID NO: 1001; (b) HCDR2 comprising the amino acid sequence of SEQ ID NO: 1002; (c) HCDR3 comprising the amino acid sequence of SEQ ID NO: 1003; (d) LCDR1 comprising the amino acid sequence of SEQ ID NO: 1004; (e) LCDR2 comprising the amino acid sequence of SEQ ID NO: 1005; and (f) LCDR3 comprising the amino acid sequence of SEQ ID NO: 1006; or xii) (a) HCDR1 comprising the amino acid sequence of SEQ ID NO: 2001; (b) HCDR2 comprising the amino acid sequence of SEQ ID NO: 2002; (c) HCDR3 comprising the amino acid sequence of SEQ ID NO: 2003; (d) LCDR1 comprising the amino acid sequence of SEQ ID NO: 2004; (e) LCDR2 comprising the amino acid sequence of SEQ ID NO: 2005; and (f) LCDR3 comprising the amino acid sequence of SEQ ID NO: 2006; or xiii) (a) HCDR1 comprising the amino acid sequence of SEQ ID NO: 3001; (b) HCDR2 comprising the amino acid sequence of SEQ ID NO: 3002; (c) HCDR3 comprising the amino acid sequence of SEQ ID NO: 3003; (d) LCDR1 comprising the amino acid sequence of SEQ ID NO: 3004; (e) LCDR2 comprising the amino acid sequence of SEQ ID NO: 3005; and (f) LCDR3 comprising the amino acid sequence of SEQ ID NO: 3006; or xiv) (a) HCDR1 comprising the amino acid sequence of SEQ ID NO: 4001; (b) HCDR2 comprising the amino acid sequence of SEQ ID NO: 4002; (c) HCDR3 comprising the amino acid sequence of SEQ ID NO: 4003; (d) LCDR1 comprising the amino acid sequence of SEQ ID NO: 4004; (e) LCDR2 comprising the amino acid sequence of SEQ ID NO: 4005; and (f) LCDR3 comprising the amino acid sequence of SEQ ID NO: 4006; or xv) (a) HCDR1 comprising the amino acid sequence of SEQ ID NO: 5001; (b) HCDR2 comprising the amino acid sequence of SEQ ID NO: 5002; (c) HCDR3 comprising the amino acid sequence of SEQ ID NO: 5003; (d) LCDR1 comprising the amino acid sequence of SEQ ID NO: 5004; (e) LCDR2 comprising the amino acid sequence of SEQ ID NO: 5005; and (f) LCDR3 comprising the amino acid sequence of SEQ ID NO: 5006; or xvi) (a) HCDR1 comprising the amino acid sequence of SEQ ID NO: 6001; (b) HCDR2 comprising the amino acid sequence of SEQ ID NO: 6002; (c) HCDR3 comprising the amino acid sequence of SEQ ID NO: 6003; (d) LCDR1 comprising the amino acid sequence of SEQ ID NO: 6004; (e) LCDR2 comprising the amino acid sequence of SEQ ID NO: 6005; and (f) LCDR3 comprising the amino acid sequence of SEQ ID NO: 6006; or xvii) (a) HCDR1 comprising the amino acid sequence of SEQ ID NO: 7001; (b) HCDR2 comprising the amino acid sequence of SEQ ID NO: 7002; (c) HCDR3 comprising the amino acid sequence of SEQ ID NO: 7003; (d) LCDR1 comprising the amino acid sequence of SEQ ID NO: 7004; (e) LCDR2 comprising the amino acid sequence of SEQ ID NO: 7005; and (f) LCDR3 comprising the amino acid sequence of SEQ ID NO: 7006; or xviii) (a) HCDR1 comprising the amino acid sequence of SEQ ID NO: 8001; (b) HCDR2 comprising the amino acid sequence of SEQ ID NO: 8002; (c) HCDR3 comprising the amino acid sequence of SEQ ID NO: 8003; (d) LCDR1 comprising the amino acid sequence of SEQ ID NO: 8004; (e) LCDR2 comprising the amino acid sequence of SEQ ID NO: 8005; and (f) LCDR3 comprising the amino acid sequence of SEQ ID NO: 8006; or xix) (a) HCDR1 comprising the amino acid sequence of SEQ ID NO: 9001; (b) HCDR2 comprising the amino acid sequence of SEQ ID NO: 9002; (c) HCDR3 comprising the amino acid sequence of SEQ ID NO: 9003; (d) LCDR1 comprising the amino acid sequence of SEQ ID NO: 9004; (e) LCDR2 comprising the amino acid sequence of SEQ ID NO: 9005; and (f) LCDR3 comprising the amino acid sequence of SEQ ID NO: 9006; or xx) (a) HCDR1 comprising the amino acid sequence of SEQ ID NO: 10001; (b) HCDR2 comprising the amino acid sequence of SEQ ID NO: 10002; (c) HCDR3 comprising the amino acid sequence of SEQ ID NO: 10003; (d) LCDR1 comprising the amino acid sequence of SEQ ID NO: 10004; (e) LCDR2 comprising the amino acid sequence of SEQ ID NO: 10005; and (f) LCDR3 comprising the amino acid sequence of SEQ ID NO: 10006; or xxi) (a) HCDR1 comprising the amino acid sequence of SEQ ID NO: 20001; (b) HCDR2 comprising the amino acid sequence of SEQ ID NO: 20002; (c) HCDR3 comprising the amino acid sequence of SEQ ID NO: 20003; (d) LCDR1 comprising the amino acid sequence of SEQ ID NO: 20004; (e) LCDR2 comprising the amino acid sequence of SEQ ID NO: 20005; and (f) LCDR3 comprising the amino acid sequence of SEQ ID NO: 20006; or xxii) (a) HCDR1 comprising the amino acid sequence of SEQ ID NO: 30001; (b) HCDR2 comprising the amino acid sequence of SEQ ID NO: 30002; (c) HCDR3 comprising the amino acid sequence of SEQ ID NO: 30003; (d) LCDR1 comprising the amino acid sequence of SEQ ID NO: 30004; (e) LCDR2 comprising the amino acid sequence of SEQ ID NO: 30005; and (f) LCDR3 comprising the amino acid sequence of SEQ ID NO: 30006.

Embodiment 3. The isolated antibody of claim 1, wherein the antibody comprises a heavy chain variable region (VH) and a light chain variable region (VL), wherein:

i) the VH is at least 90%, 91%, 92%, 93%, 94%, 95%, 96%, 97%, 98%, 99%, or 100% identical to the amino acid sequence of SEQ ID NO: 12 and the VL is at least 90%, 91%, 92%, 93%, 94%, 95%, 96%, 97%, 98%, 99%, or 100% identical to the amino acid sequence of SEQ ID NO: 18; or ii) the VH is at least 90%, 91%, 92%, 93%, 94%, 95%, 96%, 97%, 98%, 99%, or 100% identical to the amino acid sequence of SEQ ID NO: 112 and the VL is at least 90%, 91%, 92%, 93%, 94%, 95%, 96%, 97%, 98%, 99%, or 100% identical to the amino acid sequence of SEQ ID NO: 118; or iii) the VH is at least 90%, 91%, 92%, 93%, 94%, 95%, 96%, 97%, 98%, 99%, or 100% identical to the amino acid sequence of SEQ ID NO: 212 and the VL is at least 90%, 91%, 92%, 93%, 94%, 95%, 96%, 97%, 98%, 99%, or 100% identical to the amino acid sequence of SEQ ID NO: 218; or iv) the VH is at least 90%, 91%, 92%, 93%, 94%, 95%, 96%, 97%, 98%, 99%, or 100% identical to the amino acid sequence of SEQ ID NO: 312 and the VL is at least 90%, 91%, 92%, 93%, 94%, 95%, 96%, 97%, 98%, 99%, or 100% identical to the amino acid sequence of SEQ ID NO: 318; or v) the VH is at least 90%, 91%, 92%, 93%, 94%, 95%, 96%, 97%, 98%, 99%, or 100% identical to the amino acid sequence of SEQ ID NO: 412 and the VL is at least 90%, 91%, 92%, 93%, 94%, 95%, 96%, 97%, 98%, 99%, or 100% identical to the amino acid sequence of SEQ ID NO: 418; or vi) the VH is at least 90%, 91%, 92%, 93%, 94%, 95%, 96%, 97%, 98%, 99%, or 100% identical to the amino acid sequence of SEQ ID NO: 512 and the VL is at least 90%, 91%, 92%, 93%, 94%, 95%, 96%, 97%, 98%, 99%, or 100% identical to the amino acid sequence of SEQ ID NO: 518; or vii) the VH is at least 90%, 91%, 92%, 93%, 94%, 95%, 96%, 97%, 98%, 99%, or 100% identical to the amino acid sequence of SEQ ID NO: 612 and the VL is at least 90%, 91%, 92%, 93%, 94%, 95%, 96%, 97%, 98%, 99%, or 100% identical to the amino acid sequence of SEQ ID NO: 618; or viii) the VH is at least 90%, 91%, 92%, 93%, 94%, 95%, 96%, 97%, 98%, 99%, or 100% identical to the amino acid sequence of SEQ ID NO: 712 and the VL is at least 90%, 91%, 92%, 93%, 94%, 95%, 96%, 97%, 98%, 99%, or 100% identical to the amino acid sequence of SEQ ID NO: 718; or ix) the VH is at least 90%, 91%, 92%, 93%, 94%, 95%, 96%, 97%, 98%, 99%, or 100% identical to the amino acid sequence of SEQ ID NO: 812 and the VL is at least 90%, 91%, 92%, 93%, 94%, 95%, 96%, 97%, 98%, 99%, or 100% identical to the amino acid sequence of SEQ ID NO: 818; or x) the VH is at least 90%, 91%, 92%, 93%, 94%, 95%, 96%, 97%, 98%, 99%, or 100% identical to the amino acid sequence of SEQ ID NO: 912 and the VL is at least 90%, 91%, 92%, 93%, 94%, 95%, 96%, 97%, 98%, 99%, or 100% identical to the amino acid sequence of SEQ ID NO: 918; or xi) the VH is at least 90%, 91%, 92%, 93%, 94%, 95%, 96%, 97%, 98%, 99%, or 100% identical to the amino acid sequence of SEQ ID NO: 1012 and the VL is at least 90%, 91%, 92%, 93%, 94%, 95%, 96%, 97%, 98%, 99%, or 100% identical to the amino acid sequence of SEQ ID NO: 1018; or xii) the VH is at least 90%, 91%, 92%, 93%, 94%, 95%, 96%, 97%, 98%, 99%, or 100% identical to the amino acid sequence of SEQ ID NO: 2012 and the VL is at least 90%, 91%, 92%, 93%, 94%, 95%, 96%, 97%, 98%, 99%, or 100% identical to the amino acid sequence of SEQ ID NO: 2018; or xiii) the VH is at least 90%, 91%, 92%, 93%, 94%, 95%, 96%, 97%, 98%, 99%, or 100% identical to the amino acid sequence of SEQ ID NO: 3012 and the VL is at least 90%, 91%, 92%, 93%, 94%, 95%, 96%, 97%, 98%, 99%, or 100% identical to the amino acid sequence of SEQ ID NO: 3018; or xiv) the VH is at least 90%, 91%, 92%, 93%, 94%, 95%, 96%, 97%, 98%, 99%, or 100% identical to the amino acid sequence of SEQ ID NO: 4012 and the VL is at least 90%, 91%, 92%, 93%, 94%, 95%, 96%, 97%, 98%, 99%, or 100% identical to the amino acid sequence of SEQ ID NO: 4018; or xv) the VH is at least 90%, 91%, 92%, 93%, 94%, 95%, 96%, 97%, 98%, 99%, or 100% identical to the amino acid sequence of SEQ ID NO: 5012 and the VL is at least 90%, 91%, 92%, 93%, 94%, 95%, 96%, 97%, 98%, 99%, or 100% identical to the amino acid sequence of SEQ ID NO: 5018; or xvi) the VH is at least 90%, 91%, 92%, 93%, 94%, 95%, 96%, 97%, 98%, 99%, or 100% identical to the amino acid sequence of SEQ ID NO: 6012 and the VL is at least 90%, 91%, 92%, 93%, 94%, 95%, 96%, 97%, 98%, 99%, or 100% identical to the amino acid sequence of SEQ ID NO: 6018; or xvii) the VH is at least 90%, 91%, 92%, 93%, 94%, 95%, 96%, 97%, 98%, 99%, or 100% identical to the amino acid sequence of SEQ ID NO: 7012 and the VL is at least 90%, 91%, 92%, 93%, 94%, 95%, 96%, 97%, 98%, 99%, or 100% identical to the amino acid sequence of SEQ ID NO: 7018; or xviii) the VH is at least 90%, 91%, 92%, 93%, 94%, 95%, 96%, 97%, 98%, 99%, or 100% identical to the amino acid sequence of SEQ ID NO: 8012 and the VL is at least 90%, 91%, 92%, 93%, 94%, 95%, 96%, 97%, 98%, 99%, or 100% identical to the amino acid sequence of SEQ ID NO: 8018; or xix) the VH is at least 90%, 91%, 92%, 93%, 94%, 95%, 96%, 97%, 98%, 99%, or 100% identical to the amino acid sequence of SEQ ID NO: 9012 and the VL is at least 90%, 91%, 92%, 93%, 94%, 95%, 96%, 97%, 98%, 99%, or 100% identical to the amino acid sequence of SEQ ID NO: 9018; or xx) the VH is at least 90%, 91%, 92%, 93%, 94%, 95%, 96%, 97%, 98%, 99%, or 100% identical to the amino acid sequence of SEQ ID NO: 10012 and the VL is at least 90%, 91%, 92%, 93%, 94%, 95%, 96%, 97%, 98%, 99%, or 100% identical to the amino acid sequence of SEQ ID NO: 10018; or xxi) the VH is at least 90%, 91%, 92%, 93%, 94%, 95%, 96%, 97%, 98%, 99%, or 100% identical to the amino acid sequence of SEQ ID NO: 20012 and the VL is at least 90%, 91%, 92%, 93%, 94%, 95%, 96%, 97%, 98%, 99%, or 100% identical to the amino acid sequence of SEQ ID NO: 20018; or xxii) the VH is at least 90%, 91%, 92%, 93%, 94%, 95%, 96%, 97%, 98%, 99%, or 100% identical to the amino acid sequence of SEQ ID NO: 30012 and the VL is at least 90%, 91%, 92%, 93%, 94%, 95%, 96%, 97%, 98%, 99%, or 100% identical to the amino acid sequence of SEQ ID NO: 30018.

Embodiment 4. The isolated antibody of any one of embodiments 1-3, wherein the antibody comprises a heavy chain variable region (VH) and a light chain variable region (VL), wherein:

i) the VH comprises the amino acid sequence of SEQ ID NO: 12 and the VL comprises the amino acid sequence of SEQ ID NO: 18; or ii) the VH comprises the amino acid sequence of SEQ ID NO: 112 and the VL comprises the amino acid sequence of SEQ ID NO: 118; or iii) the VH comprises the amino acid sequence of SEQ ID NO: 212 and the VL comprises the amino acid sequence of SEQ ID NO: 218; or iv) the VH comprises the amino acid sequence of SEQ ID NO: 312 and the VL comprises the amino acid sequence of SEQ ID NO: 318; or v) the VH comprises the amino acid sequence of SEQ ID NO: 412 and the VL comprises the amino acid sequence of SEQ ID NO: 418; or vi) the VH comprises the amino acid sequence of SEQ ID NO: 512 and the VL comprises the amino acid sequence of SEQ ID NO: 518; or vii) the VH comprises the amino acid sequence of SEQ ID NO: 612 and the VL comprises the amino acid sequence of SEQ ID NO: 618; or viii) the VH comprises the amino acid sequence of SEQ ID NO: 712 and the VL comprises the amino acid sequence of SEQ ID NO: 718; or ix) the VH comprises the amino acid sequence of SEQ ID NO: 812 and the VL comprises the amino acid sequence of SEQ ID NO: 818; or x) the VH comprises the amino acid sequence of SEQ ID NO: 912 and the VL comprises the amino acid sequence of SEQ ID NO: 918; or xi) the VH comprises the amino acid sequence of SEQ ID NO: 1012 and the VL comprises the amino acid sequence of SEQ ID NO: 1018; or xii) the VH comprises the amino acid sequence of SEQ ID NO: 2012 and the VL comprises the amino acid sequence of SEQ ID NO: 2018; or xiii) the VH comprises the amino acid sequence of SEQ ID NO: 3012 and the VL comprises the amino acid sequence of SEQ ID NO: 3018; or xiv) the VH comprises the amino acid sequence of SEQ ID NO: 4012 and the VL comprises the amino acid sequence of SEQ ID NO: 4018; or xv) the VH comprises the amino acid sequence of SEQ ID NO: 5012 and the VL comprises the amino acid sequence of SEQ ID NO: 5018; or xvi) the VH comprises the amino acid sequence of SEQ ID NO: 6012 and the VL comprises the amino acid sequence of SEQ ID NO: 6018; or xvii) the VH comprises the amino acid sequence of SEQ ID NO: 7012 and the VL comprises the amino acid sequence of SEQ ID NO: 7018; or xviii) the VH comprises the amino acid sequence of SEQ ID NO: 8012 and the VL comprises the amino acid sequence of SEQ ID NO: 8018; or xix) the VH comprises the amino acid sequence of SEQ ID NO: 9012 and the VL comprises the amino acid sequence of SEQ ID NO: 9018; or xx) the VH comprises the amino acid sequence of SEQ ID NO: 10012 and the VL comprises the amino acid sequence of SEQ ID NO: 10018; or xxi) the VH comprises the amino acid sequence of SEQ ID NO: 20012 and the VL comprises the amino acid sequence of SEQ ID NO: 20018; or xxii) the VH comprises the amino acid sequence of SEQ ID NO: 30012 and the VL comprises the amino acid sequence of SEQ ID NO: 30018.

Embodiment 5. The isolated antibody of any one of the preceding embodiments, wherein the antibody is a monoclonal antibody.

Embodiment 6. The isolated antibody of any one of the preceding embodiments, wherein the antibody is a full-length antibody or is an antibody fragment, optionally a Fab, Fab', Fv, scFv or (Fab')$_2$.

Embodiment 7. The isolated antibody of any one of embodiments 1-5, wherein the antibody comprises an IgG1, IgG2, IgG3, or IgG4 Fc region, wherein the antibody optionally comprises a human IgG1 heavy chain constant region, a human IgG4 heavy chain constant region, or a mutant human IgG4 heavy chain constant region, wherein the mutant human IgG4 heavy chain constant region optionally comprises a mutation selected from a substitution at Ser228, a substitution at Leu235, a substitution at Asn297, or a combination thereof, numbering according to EU numbering or an S228P substitution and an L235E substitution, numbering according to EU numbering, or wherein the antibody comprises the heavy chain constant region of SEQ ID NO: 40002 or SEQ ID NO: 40003, and/or wherein the antibody optionally comprises a human kappa light chain.

Embodiment 8. The isolated antibody of any one of embodiments 1-7, wherein the antibody
(i) binds to and inhibits CD39, optionally wherein the antibody binds to CD39 and inhibits CD39 within a normal or cancerous tissue, optionally wherein the tissue is in the uterus, cervix, lung, prostate, breast, head, neck, colon, or ovary, optionally wherein the tissue is in the uterus, and optionally wherein within the uterus, the antibody inhibits CD39 in the myometrium;
(ii) inhibits or reduces an enzymatic activity of human CD39;
(iii) binds to recombinant human CD39 and/or to membrane-bound human CD39;
(iv) binds to human CD39 with an equilibrium dissociation constant ($K_D$) of less than 10 nM;
(v) binds to human CD39 with a $K_D$ of about 1.11 nM;
(iv) binds to human CD39 and cynomolgus monkey CD39 but does not bind to mouse CD39 or rat CD39;
(vii) inhibits or reduces conversion by human CD39 of extracellular adenosine triphosphate (eATP) or extracellular adenosine diphosphate (eADP) to extracellular adenosine monophosphate (eAMP);
(viii) increases or enhances a level of eATP;
(ix) decreases or reduces a level of extracellular adenosine;
(x) maintains, increases or enhances an immunostimulatory level of eATP;
(xi) antagonizes human CD39 in a tumor microenvironment of a tissue;
(xii) cross-reacts with cynomolgus CD39;
(xiii) increases or enhances proliferation of a lymphocyte;
(xiv) increases or enhances macrophage infiltration in tumors; or
(xv) reduces the activity of, or amount of, CD39 in a tumor tissue.

Embodiment 9. A pharmaceutical composition comprising the antibody of any one of embodiments 1-8 and a pharmaceutically acceptable carrier, wherein the composition optionally comprises an opsonizing agent, a regulatory T cell depleting agent, chemotherapy, and/or an antagonist of PD-1, PD-L1, CTLA-4, Lag-3, TIM-3, A2AR, A2BR, dual A2AR/A2BR, CD40 or CD73, and/or an antagonist of TIGIT, CD112R, or CD96, and/or an antagonist of PVRL1, PVRL2, PVRL3, PVRL4, or CD155, and/or an antagonist of CD47, or IL-27, and/or an agonist of STING, and/or a CAR cell therapy, optionally wherein the antagonist is an antibody.

Embodiment 10. The isolated antibody of any one of embodiments 1-8 or pharmaceutical composition of embodiment 9 for use in reducing the amount or activity of CD39 in a tissue, enhancing, increasing and/or sustaining an anti-tumor immune response in a subject, and/or inhibiting CD39 in a tissue of a subject wherein the administration reduces CD39 activity or total amount of CD39 in human tissue as compared to the activity or amount prior to administration.

Embodiment 11. The isolated antibody of any one of embodiments 1-8 or pharmaceutical composition of embodiment 9 for use in treating cancer in a subject, wherein the cancer is optionally carcinoma, lymphoma, blastoma, sarcoma, or leukemia, or wherein the cancer is optionally squamous cell cancer, small-cell lung cancer, pituitary cancer, esophageal cancer, astrocytoma, soft tissue sarcoma, non-small cell lung cancer (including squamous cell non-small cell lung cancer), adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, renal cell carcinoma, liver cancer, prostate cancer, vulval cancer, thyroid cancer, hepatic carcinoma, brain cancer, endometrial cancer, testis cancer, cholangiocarcinoma, gallbladder carcinoma, gastric cancer, melanoma, or various types of head and neck cancer (including squamous cell carcinoma of the head and neck), and/or wherein the cancer is advanced, and/or relapsed, and/or refractory, and/or metastatic, and/or wherein the cancer is an advanced solid tumor, and/or a relapsed solid tumor, and/or a refractory solid tumor, and/or a metastatic solid tumor.

Embodiment 12. The isolated antibody or pharmaceutical composition for use of embodiment 10 or 11, wherein the use further comprises administering a second therapy, wherein the second therapy is optionally radiotherapy, surgery or administration of an antagonist of PD-1, PD-L1, CTLA-4, Lag-3, TIM-3, A2AR, A2BR, A2AR/A2BR, CD40, CD73, TIGIT, CD112R, CD96, PVRL1, PVRL2, PVRL3, PVRL4, CD155, CD47, or IL-27, an agonist of STING, a CAR cell therapy, or a combination thereof, optionally wherein the antagonist is an antibody.

Embodiment 13. The isolated antibody or pharmaceutical composition for use of embodiment 10 or 11, wherein the use further comprises administering a second therapy, wherein the second therapy is an antagonist of CD47, optionally wherein the antagonist of CD47 is an anti-CD47 antibody, optionally wherein the anti-CD47 antibody comprises:
a) a heavy chain variable region (VH) and a light chain variable region (VL), wherein the VH comprises the amino acid sequence of SEQ ID NO: 40004 and the VL comprises the amino acid sequence of SEQ ID NO: 40005; and/or b) (a) HCDR1 comprising the amino acid sequence of SEQ ID NO: 40006; (b) HCDR2 comprising the amino acid sequence of SEQ ID NO: 40007; (c) HCDR3 comprising the amino acid sequence of SEQ ID NO: 40008; (d) LCDR1 comprising the amino acid sequence of SEQ ID NO: 40009; (e) LCDR2 comprising the amino acid sequence of SEQ ID NOL 40010; and (f) LCDR3 comprising the amino acid sequence of SEQ ID NO: 40011.

Embodiment 14. A nucleic acid encoding the antibody of any one of embodiments 1-8.

Embodiment 15. A host cell comprising the nucleic acid of any one of embodiments 1-8.

Embodiment 16. A method of producing the antibody of any one of embodiments 1-8 comprising culturing the host cell of embodiment 15 under conditions wherein the antibody is expressed, optionally further comprising purifying the antibody.

BRIEF DESCRIPTION OF THE FIGURES

FIGS. 4A, 4B, 4C, and 4D depict the ability of anti-CD39 antibodies over a dose range, as compared to a control IgG1 antibody, to inhibit the enzymatic activity of CD39 in monocytes (FIGS. 4A and 4B) and B cells (FIGS. 4C and 4D).

FIGS. 5A and 5B show affinity measurements for anti-CD39 antibodies.

FIG. 21A shows an increase in frequency of CD45+ cells within the CD8+ cluster of cells and within the lymphocyte cluster of cells in isotype and anti-PD1 antibody treated populations as compared to the isotype control antibody. FIG. 21B shows the number of CD8+ cells per mm$^2$ as identified by immunohistochemistry (IHC) in untreated CT26 mice, or CT26 mice treated with isotype control antibody ("Group 1 Iso"), anti-murine CD39 ("Group 2 CD39"), anti-murine PD-1 ("Group 3 PD-1"), or anti-murine CD39+anti-murine PD-1 ("Group 4 Combo"). FIG.

21C shows representative IHC images of tumor samples isolated from CT26 mice treated with anti-murine PD-1 (bottom image) or isotype control antibody (top image).

Figure 22:
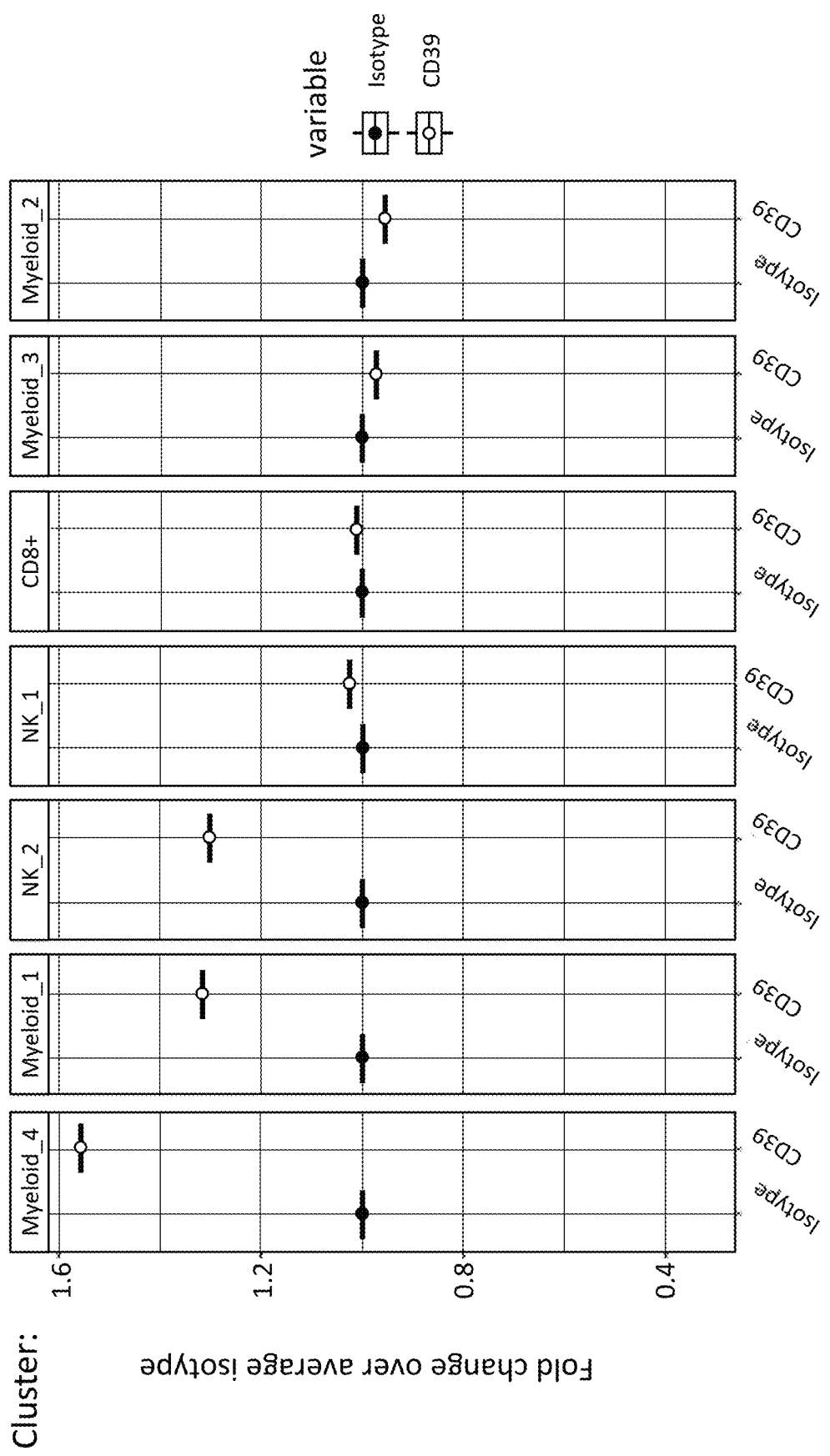
Figure 22:
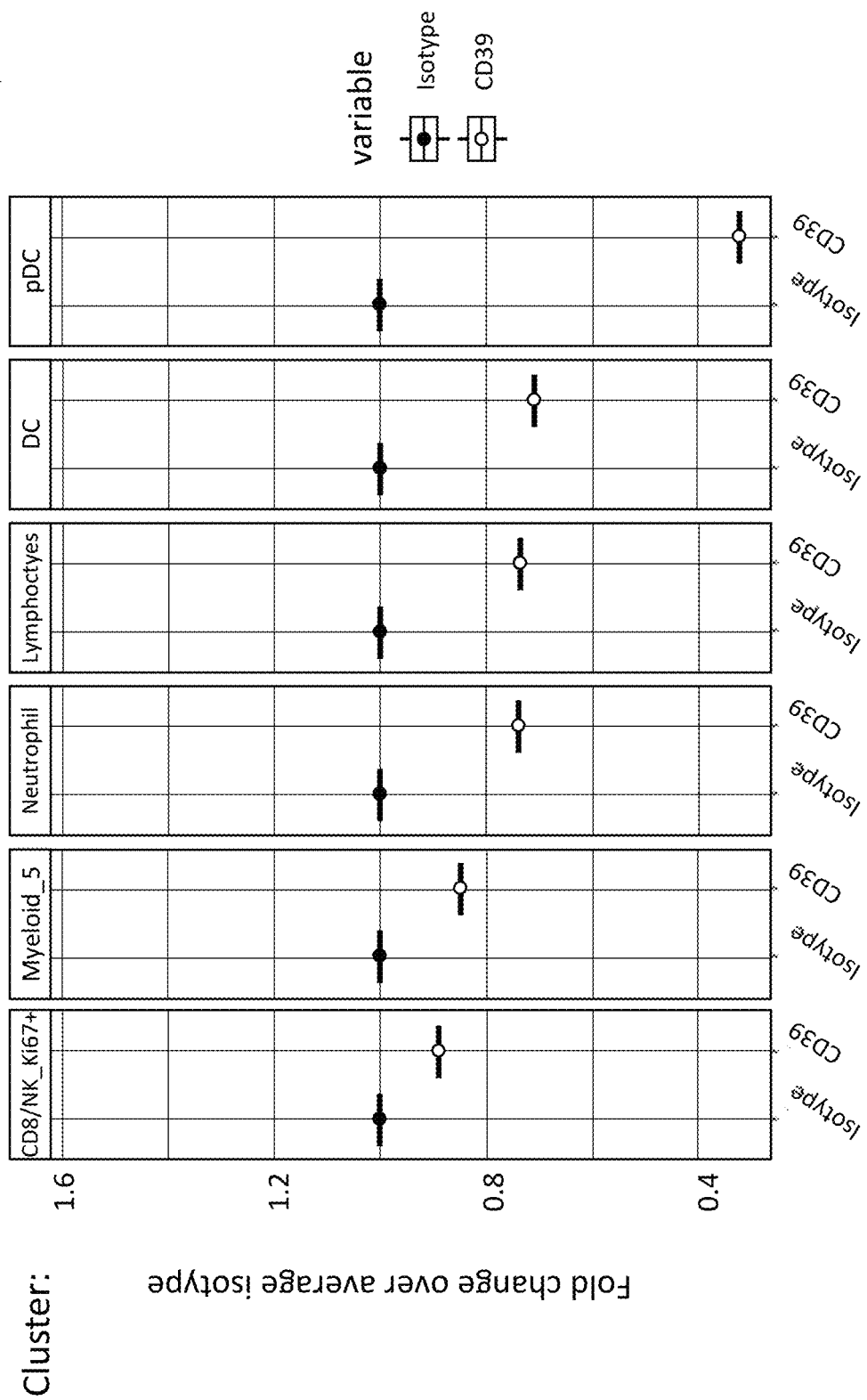

FIG. 22 shows the frequency of immune cell types infiltrating the TME of CT26 mice treated with anti-murine CD39 antibody or isotype control antibody using scRNAseq analysis. The frequency of each cell type cluster is shown as a fold change over the average fold change for the isotype control group.

Figure 23A:
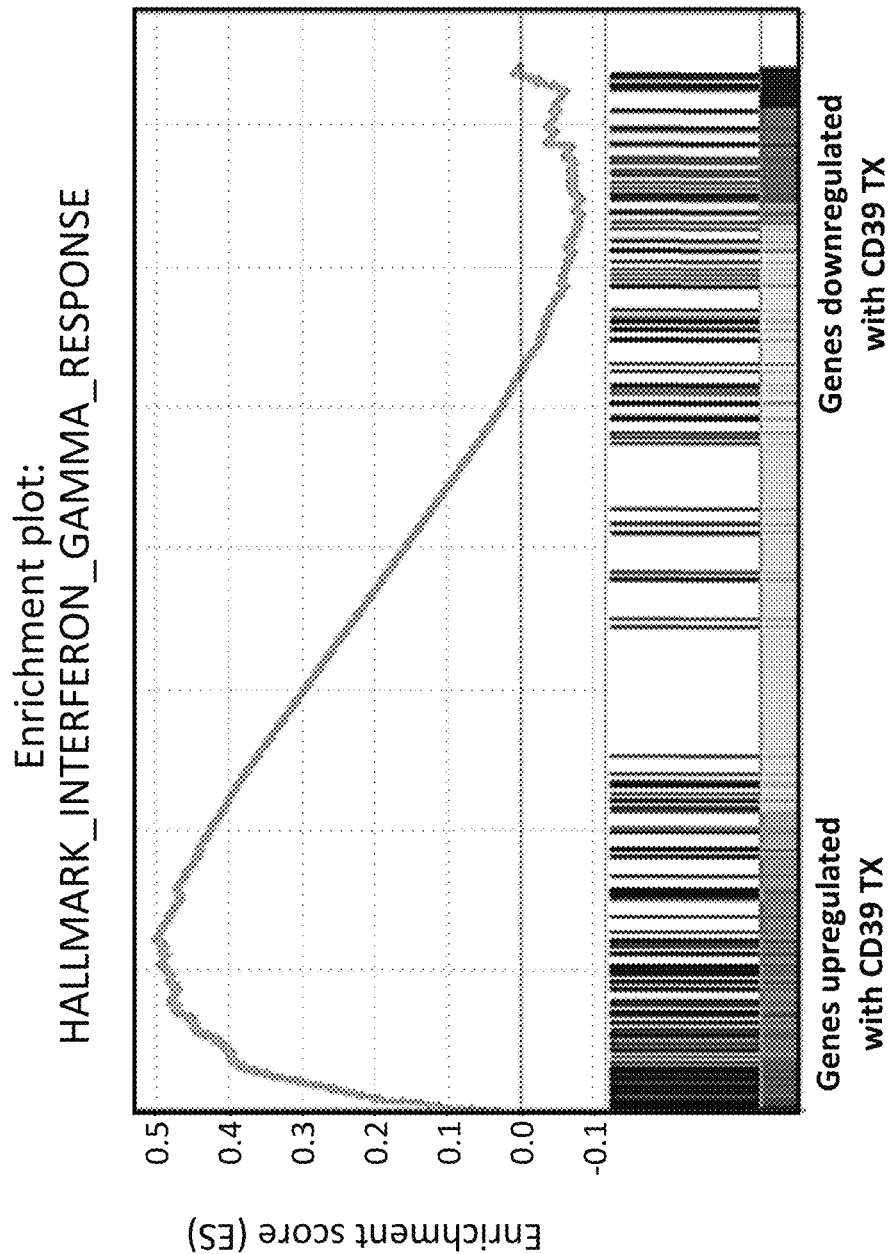
Figure 23B:
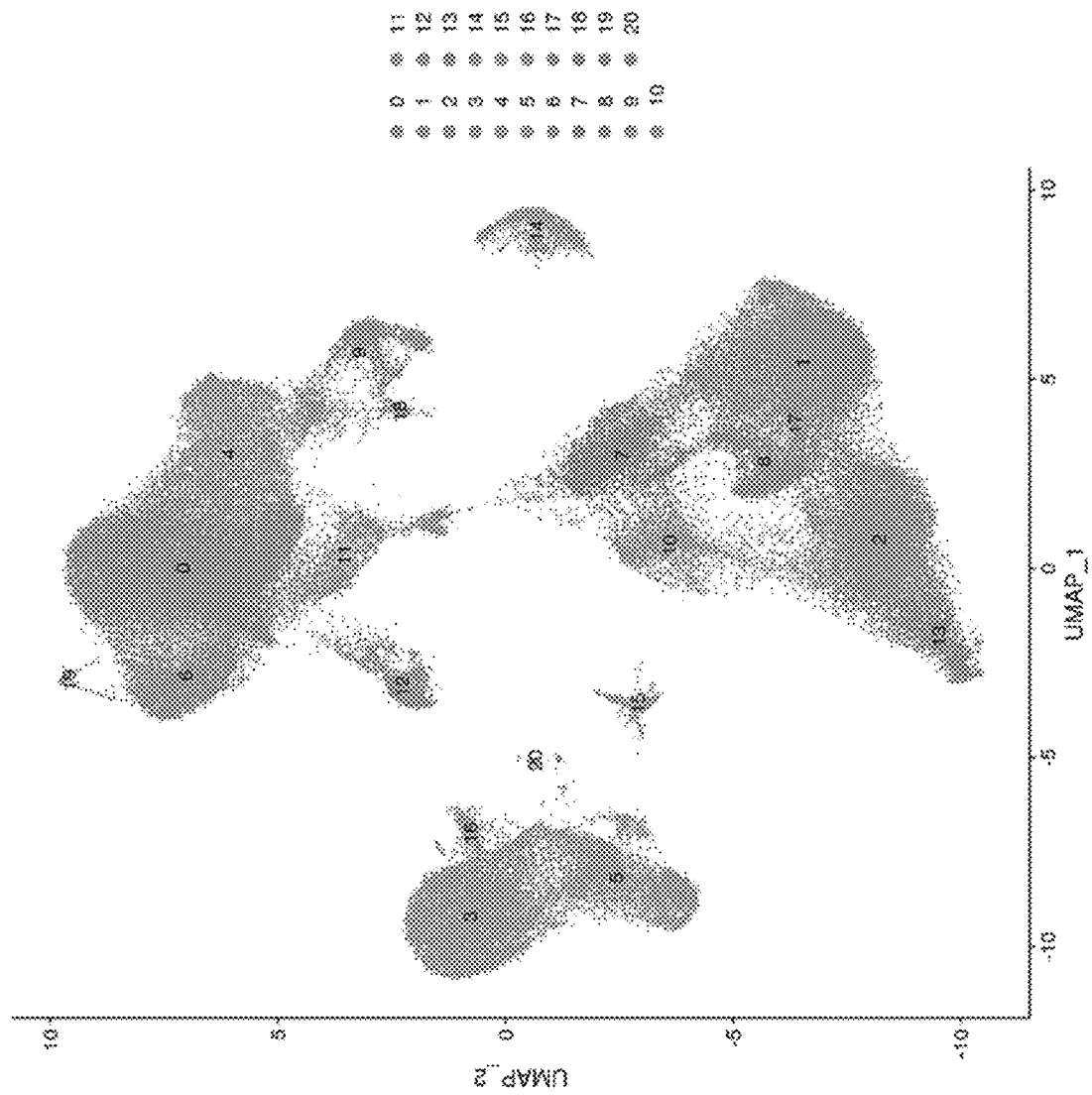

FIGS. 23A-B shows upregulation of IFNγ-response genes in tumor-associated macrophages following anti-CD39 antibody treatment ("CD39 TX"). Tumor-associated macrophages were identified from the scRNAseq dataset based on F4/80 antigen expression. Differential expression analysis was performed using Gene Set Enrichment Analysis (GSEA) and hallmark gene sets (as derived by the aggregation of multiple gene sets in GSEA to demonstrate well defined biological states; see worldwide web at gsea-msigdb.org/gsea/msigdb/collections.jsp#H) to rank genes more highly expressed in the anti-murine CD39 group v. isotype control. The top enriched genes based on enrichment score (ES) were related to an upregulated IFNγ response (FIG. 23A). P-value=0.0. FDR q-value=0.005. Cells were clustered using UMAP dimensionality reduction, resulting in approximately 20 distinct populations (FIG. 23B).

Figure 24:
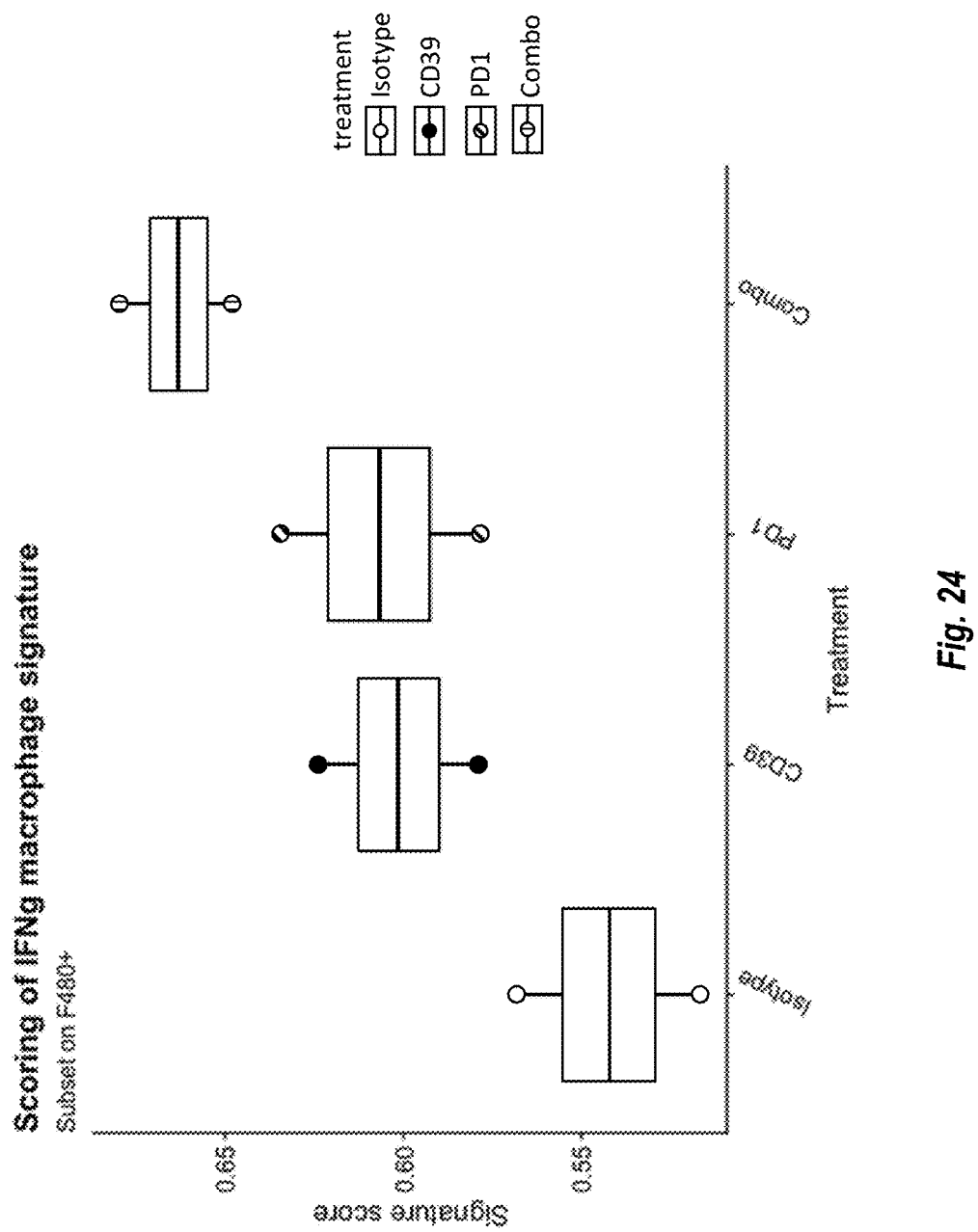

FIG. 24 shows scoring for an IFNγ signature in tumor-associated macrophages following treatment with isotype control antibody, anti-murine CD39 antibody ("CD39"), anti-murine PD-1 antibody ("PD1"), or anti-murine CD39 antibody+anti-murine PD-1 antibody ("combo"). Tumor-associated macrophages were identified from the scRNAseq dataset based on F4/80 antigen expression. Scores for IFNγ signature were calculated by taking the mean expression of IFNγ signature genes in cluster of cells identified as macrophages, based on F4/80 expression.

Figure 25:
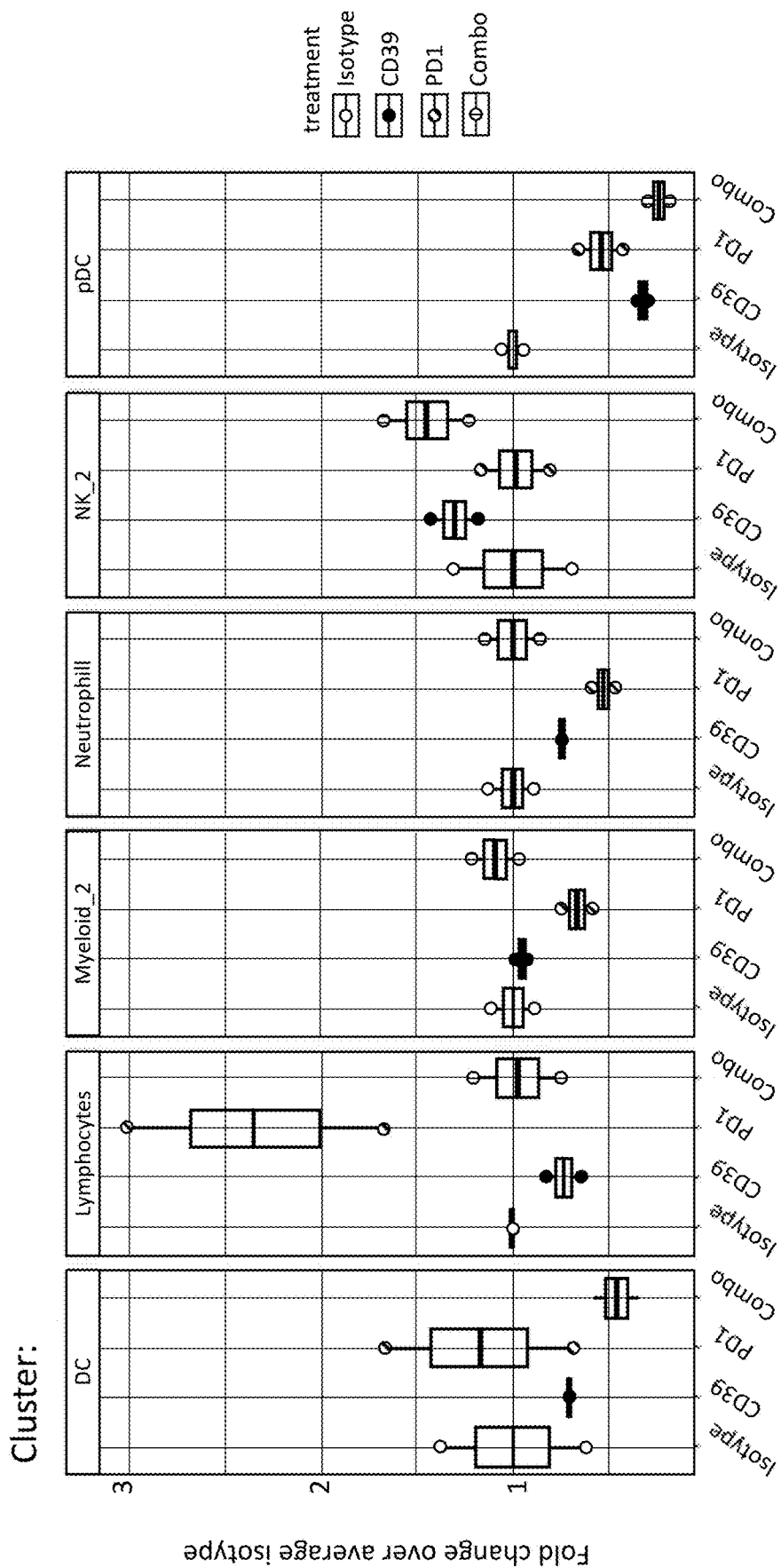

FIG. 25 shows the frequency of cell types infiltrating the TME of CT26 mice treated with isotype control antibody, anti-murine CD39 ("CD39"), anti-murine PD-1 ("PD1"), or anti-murine CD39+anti-murine PD-1 ("Combo") using scRNAseq analysis. The frequency of each cell type cluster is shown as a fold change over the average fold change for the isotype control group.

DETAILED DESCRIPTION OF EMBODIMENTS OF THE INVENTION

II. DEFINITIONS

In this application, the use of "or" means "and/or" unless stated otherwise. In the context of a multiple dependent claim, the use of "or" refers back to more than one preceding independent or dependent claim in the alternative only. The terms "comprising," "including," and "having" can be used interchangeably herein.

The term "CD39" refers to the ectonucleoside triphosphate diphospholydrolase 1 polypeptide encoded in humans by the ENTPD1 gene. Other names for CD39 include ENTPD1, E-NTPDase1, cluster of differentiation 39, ATP-Dase, NTPDase-1, and SPG64. CD39 catalyzes the hydrolysis of γ- and β-phosphate residues of extracellular nucleoside triphosphates (NTPs; e.g., adenosine triphosphate or ATP) and nucleoside diphosphates (NDPs; e.g., adenosine diphosphate or ADP), converting these molecules to the nucleoside monophosphate (NMP; e.g., adenosine monophosphate or AMP) derivative. An exemplary amino acid sequence of CD39 is at NCBI Reference Sequence: NP_001767.3.

"Affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant ($K_D$). Affinity can be measured by common methods known in the art, including those described herein. Specific illustrative and exemplary embodiments for measuring binding affinity are described in the following.

An "affinity matured" antibody refers to an antibody with one or more alterations in one or more hypervariable regions (HVRs), compared to a parent antibody which does not possess such alterations, such alterations optionally resulting in an improvement in the affinity of the antibody for antigen.

The term "antagonist," as used herein, refers to an inhibitor of a target molecule and may be used synonymously herein with the term "inhibitor." Antagonists include, but are not limited to, antibodies (e.g., monoclonal antibodies, polyclonal antibodies, multispecific antibodies, bispecific antibodies, and antibody fragments), ligands, fusion proteins, small molecules, multivalent agents, and other antagonistic/inhibitory agents.

The term "antibody" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; single-chain antibody molecules (e.g. scFv); and multispecific antibodies formed from antibody fragments.

The term "block," in the context of an interaction between two or more molecules, is used herein to refer to inhibition or prevention of said interaction between the two or more molecules, wherein the inhibition or prevention of said interaction between the two or more molecules is complete or nearly complete under at least one condition. A "nearly complete" inhibition is a percent inhibition of about 70-99.9%, and a "complete" inhibition is 100%. For example, a molecule is said to "block" an interaction between two or more other molecules if it completely or nearly completely inhibits such interaction at certain concentrations in a dose dependent manner.

The term "cancer" is used herein to refer to a group of cells that exhibit abnormally high levels of proliferation and growth. A cancer may be benign (also referred to as a benign tumor), pre-malignant, or malignant. Cancer cells may be solid cancer cells or leukemic cancer cells. The term "tumor" is used herein to refer to a cell or cells that comprise a cancer. The term "tumor growth" is used herein to refer to proliferation or growth by a cell or cells that comprise a cancer that leads to a corresponding increase in the size or extent of the cancer.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain.

There are five major classes of antibodies: IgA, IgD, IgE, IgG, and IgM, and several of these may be further divided into subclasses (isotypes), e.g., $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ, respectively.

Administration "in combination with" one or more further therapeutic agents includes simultaneous (concurrent) and consecutive (sequential) administration in any order.

The term "cytotoxic agent" as used herein refers to a substance that inhibits or prevents a cellular function and/or causes cell death or destruction. Cytotoxic agents include, but are not limited to, radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$, $P^{212}$ and radioactive isotopes of Lu); chemotherapeutic agents or drugs (e.g., methotrexate, adriamicin, vinca alkaloids (vincristine, vinblastine, etoposide), doxorubicin, melphalan, mitomycin C, chlorambucil, daunorubicin or other intercalating agents); growth inhibitory agents; enzymes and fragments thereof such as nucleolytic enzymes; antibiotics; toxins such as small molecule toxins or enzymatically active toxins of bacterial, fungal, plant or animal origin, including fragments and/or variants thereof; and the various antitumor or anticancer agents disclosed below.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g. B cell receptor); and B cell activation.

An "effective amount" of an agent, e.g., a pharmaceutical formulation, refers to an amount effective, at dosages and for periods of time necessary, to achieve the desired therapeutic or prophylactic result.

The term "Fc region" herein is used to define a C-terminal region of an immunoglobulin heavy chain that contains at least a portion of the constant region. The term includes native sequence Fc regions and variant Fc regions. In some embodiments, a human IgG heavy chain Fc region extends from Cys226, or from Pro230, to the carboxyl-terminus of the heavy chain. However, the C-terminal lysine (Lys447) of the Fc region may or may not be present (numbering in this paragraph is according to the EU numbering system, also called the EU index, as described in Kabat et al., *Sequences of Proteins of Immunological Interest*, 5th Ed. Public Health Service, National Institutes of Health, Bethesda, Md., 1991).

"Framework," "framework region," or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The terms "full length antibody," "intact antibody," and "whole antibody" are used herein interchangeably to refer to an antibody having a structure substantially similar to a native antibody structure or having heavy chains that contain an Fc region as defined herein.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, and may contain mutations. Mutant progeny that have the same function or biological activity as screened or selected for in the originally transformed cell are included herein.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). (See, e.g., Kindt et al. *Kuby Immunology*, 6th ed., W. H. Freeman and Co., page 91 (2007).) A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., *J. Immunol.* 150:880-887 (1993); Clarkson et al., *Nature* 352:624-628 (1991).

A "human consensus framework" is a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., *Sequences of Proteins of Immunological Interest*, Fifth Edition, NIH Publication 91-3242, Bethesda Md. (1991), vols. 1-3. In some embodiments, for the VL, the subgroup is subgroup kappa I as in Kabat et al., supra. In some embodiments, for the VH, the subgroup is subgroup III as in Kabat et al., supra.

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3).

An "immunoconjugate" is an antibody conjugated to one or more heterologous molecule(s), including but not limited to a cytotoxic agent.

An "individual" or "subject" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the individual or subject is a human.

An increase in "interferon gamma response" or "IFNγ response" or "IFN-γ response" refers to any increase in activity associated with the cytokine IFNγ, and includes, e.g., an increase in IFNγ protein (e.g., present in the TME, secreted from a cell, or detected intracellularly), an increase in IFNγ gene expression in a cell (e.g., by measuring mRNA levels), an increase in gene expression of genes related to IFNγ (e.g., by measuring mRNA levels) (e.g., genes related to IFNγ include, e.g., genes listed in Table 3). The increase may be detected in a sample from an individual after administration of a therapy e.g., as compared to a sample from an untreated individual. In some embodiments, increase may be detected in a sample from an individual after administration of a first and a second therapy e.g., as compared to a sample from an individual after administration of only the first or the second therapy.

"Infiltration" of immune cells (e.g., innate immune cells) refers to an increase in the number of immune cells detected in a location (e.g., the tumor microenvironment). Infiltration can be detected e.g., by measuring the number of immune cells (e.g., by cell type) in a sample from an individual after administration of a therapy e.g., as compared to a sample from an untreated individual. In some embodiments, infiltration can be detected e.g., by measuring the amount of immune cells (e.g., by cell type) in a sample from an individual after administration of a first and a second therapy e.g., as compared to a sample from an individual after administration of only the first or the second therapy. Standard techniques can be used to detect infiltration of immune cells, including, e.g., flow cytometry of cells isolated from the tumor microenvironment, measuring gene expression of cells isolated from the tumor microenvironment for differential expression of immune cell markers, or immunohistochemistry staining of tumor samples.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., *J. Chromatogr. B* 848:79-87 (2007).

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

A "naked antibody" refers to an antibody that is not conjugated to a heterologous moiety (e.g., a cytotoxic moiety) or radiolabel. The naked antibody may be present in a pharmaceutical formulation.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide-bonded. From N- to C-terminus, each heavy chain has a variable region (VH), also called a variable heavy domain or a heavy chain variable domain, followed by three constant domains (CH1, CH2, and CH3). Similarly, from N- to C-terminus, each light chain has a variable region (VL), also called a variable light domain or a light chain variable domain, followed by a constant light (CL) domain. The light chain of an antibody may be assigned to one of two types, called kappa (κ) and lambda (λ), based on the amino acid sequence of its constant domain.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The term "pharmaceutical formulation" or "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation or composition, other than an active ingredient, which is nontoxic to a subject. A pharmaceutically acceptable carrier includes, but is not limited to, a buffer, excipient, stabilizer, or preservative.

The term "refractory," as used herein, refers to a cancer that has not responded to a prior treatment. Refractory cancer includes a cancer that has exhibited an inadequate response to, a partial response to, or progressed on, a prior treatment, e.g., a prior treatment with an immune-oncology or immunotherapy drug, e.g., with a blocking CTLA-4 or PD-1 antibody. In some embodiments, the cancer is refractory or resistant to a prior treatment, either intrinsically refractory or resistant (e.g., refractory to a PD-1 pathway antagonist), or a resistance or refractory state is acquired. The term "relapsed," as used herein refers to a reoccurrence of a cancer in a subject. The term "metastatic," as used herein refers to a cancer cell that has changed position from the place where it started, for example, the spread of a cancer from a primary site to another place in the body. The term "advanced," as used herein refers to cancer that is unlikely to be cured or controlled with treatment.

As used herein, "treatment" (and grammatical variations thereof such as "treat" or "treating") refers to clinical intervention in an attempt to alter the natural course of the individual being treated and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, disclosed antibodies are used to delay development of a disease or to slow the progression of a disease.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

III. COMPOSITIONS AND METHODS

Anti-CD39 antibodies, compositions comprising the described antibodies and methods of their use are provided.

A. Exemplary Anti-CD39 Antibodies

The Sequence Table below provides the sequences of certain embodiments of the antibodies disclosed and claimed herein.

In certain embodiments, isolated antibodies are provided that bind to CD39.

Provided herein are isolated antibodies that bind specifically to CD39.

In some embodiments, the antibodies bind to human CD39.

In some embodiments, the antibodies bind to and inhibit CD39. In some embodiments, anti-CD39 antibodies are provided that reduce or inhibit the enzymatic activity of human CD39. In some embodiments, the anti-CD39 antibodies bind to recombinant CD39 and/or to membrane bound human CD39. In some embodiments, the anti-CD39 antibodies bind to human CD39 with an equilibrium dissociation constant ($K_D$) of less than 10 nM. In some embodiments, the $K_D$ for binding to human CD39 is about 1.11 nM. In some embodiments, the antibodies bind to human CD39 and cynomolgus monkey CD39 but do not bind to mouse CD39 or rat CD39. In some embodiments, the anti-CD39 antibodies inhibit or reduce conversion by human CD39 of extracellular adenosine triphosphate (eATP) or extracellular adenosine diphosphate (eADP) to extracellular adenosine monophosphate (eAMP). In some embodiments, the anti-CD39 antibodies increase the amount of eATP. In some embodiments, the anti-CD39 antibodies reduce or decrease the amount of extracellular adenosine. In some embodiments, the anti-CD39 antibodies maintain, increase or enhance an immunostimulatory level of eATP. In some embodiments, the anti-CD39 antibodies antagonize human CD39 in a tumor microenvironment of a tissue. In some embodiments, the anti-CD39 antibodies cross-react with cynomolgus CD39. In some embodiments, the anti-CD39 antibodies increase or enhance proliferation of a lymphocyte. In some embodiments, the anti-CD39 antibodies increase or enhance macrophage infiltration in tumors. In some embodiments, the antibodies bind to CD39 and inhibit CD39 within a normal or cancerous tissue. In some embodiments, the tissue is in the uterus, cervix, lung, prostate, breast, head, neck, colon, or ovary. In some embodiments, the tissue is in the uterus. In some embodiments, within the uterus, the antibodies inhibit CD39 in the myometrium.

In certain embodiments, a CD39 antibody comprises a heavy chain variable region ("VH") comprising VH CDR1, CDR2 and/or CDR3 of any of the CD39 antibodies provided herein (i.e., antibody clone numbers 1-22).

In certain embodiments, a CD39 antibody comprises a VH comprising VH CDR1, CDR2 and/or CDR3 of any of the CD39 antibodies provided herein and a VL comprising CDR1, CDR2 and/or CDR3 of any of the CD39 antibodies provided herein. In certain embodiments, a CD39 antibody comprises a VH comprising VH CDR1, CDR2 and/or CDR3 of any one of antibody clone numbers 1-22, and a VL comprising VL CDR1, CDR2, and/or CDR3 of any one of antibody clone numbers 1-22, optionally wherein the VH and VL CDRs are from the same antibody clone.

In some embodiments, antibodies comprising the following are provided:
  (a) HCDR1 comprising the amino acid sequence of SEQ ID NO: 1; (b) HCDR2 comprising the amino acid sequence of SEQ ID NO: 2; (c) HCDR3 comprising the amino acid sequence of SEQ ID NO: 3; with or without (d) LCDR1 comprising the amino acid sequence of SEQ ID NO: 4; (e) LCDR2 comprising the amino acid sequence of SEQ ID NO: 5; and (f) LCDR3 comprising the amino acid sequence of SEQ ID NO: 6; or
  (b) HCDR1 comprising the amino acid sequence of SEQ ID NO: 101; (b) HCDR2 comprising the amino acid sequence of SEQ ID NO: 102; (c) HCDR3 comprising the amino acid sequence of SEQ ID NO: 103; with or without (d) LCDR1 comprising the amino acid sequence of SEQ ID NO: 104; (e) LCDR2 comprising the amino acid sequence of SEQ ID NO: 105; and (f) LCDR3 comprising the amino acid sequence of SEQ ID NO: 106; or
  (c) HCDR1 comprising the amino acid sequence of SEQ ID NO: 201; (b) HCDR2 comprising the amino acid sequence of SEQ ID NO: 202; (c) HCDR3 comprising the amino acid sequence of SEQ ID NO: 203; with or without (d) LCDR1 comprising the amino acid sequence of SEQ ID NO: 204; (e) LCDR2 comprising the amino acid sequence of SEQ ID NO: 205; and (f) LCDR3 comprising the amino acid sequence of SEQ ID NO: 206; or (d) HCDR1 comprising the amino acid sequence of SEQ ID NO: 301; (b) HCDR2 comprising the amino acid sequence of SEQ ID NO: 302; (c) HCDR3 comprising the amino acid sequence of SEQ ID NO: 303; with or without (d) LCDR1 comprising the amino acid sequence of SEQ ID NO: 304; (e) LCDR2 comprising the amino acid sequence of SEQ ID NO: 305; and (f) LCDR3 comprising the amino acid sequence of SEQ ID NO: 306; or (e) HCDR1 comprising the amino acid sequence of SEQ ID NO: 401; (b) HCDR2 comprising the amino acid sequence of SEQ ID NO: 402; (c) HCDR3 comprising the amino acid sequence of SEQ ID NO: 403; with or without (d) LCDR1 comprising the amino acid sequence of SEQ ID NO: 404; (e) LCDR2 comprising the amino acid sequence of SEQ ID NO: 405; and (f) LCDR3 comprising the amino acid sequence of SEQ ID NO: 406; or (f) HCDR1 comprising the amino acid sequence of SEQ ID NO: 501; (b) HCDR2 comprising the amino acid sequence of SEQ ID NO: 502; (c) HCDR3 comprising the amino acid sequence of SEQ ID NO: 503; with or without (d) LCDR1 comprising the amino acid sequence of SEQ ID NO: 504; (e) LCDR2 comprising the amino acid sequence of SEQ ID NO: 505; and (f) LCDR3 comprising the amino acid sequence of SEQ ID NO: 506; or (g) HCDR1 comprising the amino acid sequence of SEQ ID NO: 601; (b) HCDR2 comprising the amino acid sequence of SEQ ID NO: 602; (c) HCDR3 comprising the amino acid sequence of SEQ ID NO: 603; with or without (d) LCDR1 comprising the amino acid sequence of SEQ ID NO: 604; (e) LCDR2 comprising the amino acid sequence of SEQ ID NO: 605; and (f) LCDR3 comprising the amino acid sequence of SEQ ID NO: 606; or (h) HCDR1 comprising the amino acid sequence of SEQ ID NO: 701; (b) HCDR2 comprising the amino acid sequence of SEQ ID NO: 702; (c) HCDR3 comprising the amino acid sequence of SEQ ID NO: 703; with or without (d) LCDR1 comprising the amino acid sequence of SEQ ID NO: 704; (e) LCDR2 comprising the amino acid sequence of SEQ ID NO: 705; and (f) LCDR3 comprising the amino acid sequence of SEQ ID NO: 706; or (i) HCDR1 comprising the amino acid sequence of SEQ ID NO: 801; (b) HCDR2 comprising the amino acid sequence of SEQ ID NO: 802; (c) HCDR3 comprising the amino acid sequence of SEQ ID NO: 803; with or without (d) LCDR1 comprising the amino acid sequence of SEQ ID NO: 804; (e) LCDR2 comprising the amino acid sequence of SEQ ID NO: 805; and (f) LCDR3 comprising the amino acid sequence of SEQ ID NO: 806; or (j) (a) HCDR1 comprising the amino acid sequence of SEQ ID NO: 901; (b) HCDR2 comprising the amino acid sequence of SEQ ID NO: 902; (c) HCDR3 comprising the amino acid sequence of SEQ ID NO: 903; (d) LCDR1 comprising the amino acid sequence of SEQ ID NO: 904; (e) LCDR2 comprising the amino acid sequence of SEQ ID NO: 905; and (f) LCDR3 comprising the amino acid sequence of SEQ ID NO: 906; or (k) (a) HCDR1 comprising the amino acid sequence of SEQ ID NO: 1001; (b) HCDR2 comprising the amino acid sequence of SEQ ID NO: 1002; (c) HCDR3 comprising the amino acid sequence of SEQ ID NO: 1003; (d) LCDR1 comprising the amino acid sequence of SEQ ID NO: 1004; (e) LCDR2 comprising the amino acid sequence of SEQ ID NO: 1005; and (f) LCDR3 comprising the amino acid sequence of SEQ ID NO: 1006; or (l) (a) HCDR1 comprising the amino acid sequence of SEQ ID NO: 2001; (b) HCDR2 comprising the amino acid sequence of SEQ ID NO: 2002; (c) HCDR3 comprising the amino acid sequence of SEQ ID NO: 2003; (d) LCDR1 comprising the amino acid sequence of SEQ ID NO: 2004; (e) LCDR2 comprising the amino acid sequence of SEQ ID NO: 2005; and (f) LCDR3 comprising the amino acid sequence of SEQ ID NO: 2006; or (m) (a) HCDR1 comprising the amino acid sequence of SEQ ID NO: 3001; (b) HCDR2 comprising the amino acid sequence of SEQ ID NO: 3002; (c) HCDR3 comprising the amino acid sequence of SEQ ID NO: 3003; (d) LCDR1 comprising the amino acid sequence of SEQ ID NO: 3004; (e) LCDR2 comprising the amino acid sequence of SEQ ID NO: 3005; and (f) LCDR3 comprising the amino acid sequence of SEQ ID NO: 3006; or (n) (a) HCDR1 comprising the amino acid sequence of SEQ ID NO: 4001; (b) HCDR2 comprising the amino acid sequence of SEQ ID NO: 4002; (c) HCDR3 comprising the amino acid sequence of SEQ ID NO: 4003; (d) LCDR1 comprising the amino acid sequence of SEQ ID NO: 4004; (e) LCDR2 comprising the amino acid sequence of SEQ ID NO: 4005; and (f) LCDR3 comprising the amino acid sequence of SEQ ID NO: 4006; or (o) (a) HCDR1 comprising the amino acid sequence of SEQ ID NO: 5001; (b) HCDR2 comprising the amino acid sequence of SEQ ID NO: 5002; (c) HCDR3 comprising the amino acid sequence of SEQ ID NO: 5003; (d) LCDR1 comprising the amino acid sequence of SEQ ID NO: 5004; (e) LCDR2 comprising the amino acid sequence of SEQ ID NO: 5005; and (f) LCDR3 comprising the amino acid sequence of SEQ ID NO: 5006; or (p) (a) HCDR1 comprising the amino acid sequence of SEQ ID NO: 6001; (b) HCDR2 comprising the amino acid sequence of SEQ ID NO: 6002; (c) HCDR3 comprising the amino acid sequence of SEQ ID NO: 6003; (d) LCDR1 comprising the amino acid sequence of SEQ ID NO: 6004; (e) LCDR2 comprising the amino acid sequence of SEQ ID NO: 6005; and (f) LCDR3 comprising the amino acid sequence of SEQ ID NO: 6006; or (q) (a) HCDR1 comprising the amino acid sequence of SEQ ID NO: 7001; (b) HCDR2 comprising the amino acid sequence of SEQ ID NO: 7002; (c) HCDR3 comprising the amino acid sequence of SEQ ID NO: 7003; (d) LCDR1 comprising the amino acid sequence of SEQ ID NO: 7004; (e) LCDR2 comprising the amino acid sequence of SEQ ID NO: 7005; and (f) LCDR3 comprising the amino acid sequence of SEQ ID NO: 7006; or (r) (a) HCDR1 comprising the amino acid sequence of SEQ ID NO: 8001; (b) HCDR2 comprising the amino acid sequence of SEQ ID NO: 8002; (c) HCDR3 comprising the amino acid sequence of SEQ ID NO:

8003; (d) LCDR1 comprising the amino acid sequence of SEQ ID NO: 8004; (e) LCDR2 comprising the amino acid sequence of SEQ ID NO: 8005; and (f) LCDR3 comprising the amino acid sequence of SEQ ID NO: 8006; or
(s) (a) HCDR1 comprising the amino acid sequence of SEQ ID NO: 9001; (b) HCDR2 comprising the amino acid sequence of SEQ ID NO: 9002; (c) HCDR3 comprising the amino acid sequence of SEQ ID NO: 9003; (d) LCDR1 comprising the amino acid sequence of SEQ ID NO: 9004; (e) LCDR2 comprising the amino acid sequence of SEQ ID NO: 9005; and (f) LCDR3 comprising the amino acid sequence of SEQ ID NO: 9006; or
(t) (a) HCDR1 comprising the amino acid sequence of SEQ ID NO: 10001; (b) HCDR2 comprising the amino acid sequence of SEQ ID NO: 10002; (c) HCDR3 comprising the amino acid sequence of SEQ ID NO: 10003; (d) LCDR1 comprising the amino acid sequence of SEQ ID NO: 10004; (e) LCDR2 comprising the amino acid sequence of SEQ ID NO: 10005; and (f) LCDR3 comprising the amino acid sequence of SEQ ID NO: 10006; or
(u) (a) HCDR1 comprising the amino acid sequence of SEQ ID NO: 20001; (b) HCDR2 comprising the amino acid sequence of SEQ ID NO: 20002; (c) HCDR3 comprising the amino acid sequence of SEQ ID NO: 20003; (d) LCDR1 comprising the amino acid sequence of SEQ ID NO: 20004; (e) LCDR2 comprising the amino acid sequence of SEQ ID NO: 20005; and (f) LCDR3 comprising the amino acid sequence of SEQ ID NO: 20006; or
(v) (a) HCDR1 comprising the amino acid sequence of SEQ ID NO: 30001; (b) HCDR2 comprising the amino acid sequence of SEQ ID NO: 30002; (c) HCDR3 comprising the amino acid sequence of SEQ ID NO: 30003; (d) LCDR1 comprising the amino acid sequence of SEQ ID NO: 30004; (e) LCDR2 comprising the amino acid sequence of SEQ ID NO: 30005; and (f) LCDR3 comprising the amino acid sequence of SEQ ID NO: 30006.

In certain embodiments, a CD39 antibody comprises a VL comprising VL CDR1, CDR2 and CDR3 of any of the CD39 antibodies provided herein. In certain embodiments, a CD39 antibody comprises a VL comprising VL CDR1, CDR2 and CDR3 of any one of antibody clone numbers 1-22.

In some embodiments, a CD39 antibody may comprise:
(a) a VH comprising the amino acid sequence of the VH CDR1, CDR2 and CDR3 of antibody clone number 1 and a VL comprising the VL CDR1, CDR2 and CDR3 of antibody clone number 1; or
(b) a VH comprising the amino acid sequence of the VH CDR1, CDR2 and CDR3 of antibody clone number 2 and a VL comprising the VL CDR1, CDR2 and CDR3 of antibody clone number 2; or
(c) a VH comprising the amino acid sequence of the VH CDR1, CDR2 and CDR3 of antibody clone number 3 and a VL comprising the VL CDR1, CDR2 and CDR3 of antibody clone number 3; or
(d) a VH comprising the amino acid sequence of the VH CDR1, CDR2 and CDR3 of antibody clone number 4 and a VL comprising the VL CDR1, CDR2 and CDR3 of antibody clone number 4; or
(e) a VH comprising the amino acid sequence of the VH CDR1, CDR2 and CDR3 of antibody clone number 5 and a VL comprising the VL CDR1, CDR2 and CDR3 of antibody clone number 5; or
(f) a VH comprising the amino acid sequence of the VH CDR1, CDR2 and CDR3 of antibody clone number 6 and a VL comprising the VL CDR1, CDR2 and CDR3 of antibody clone number 6; or
(g) a VH comprising the amino acid sequence of the VH CDR1, CDR2 and CDR3 of antibody clone number 7 and a VL comprising the VL CDR1, CDR2 and CDR3 of antibody clone number 7; or
(h) a VH comprising the amino acid sequence of the VH CDR1, CDR2 and CDR3 of antibody clone number 8 and a VL comprising the VL CDR1, CDR2 and CDR3 of antibody clone number 8; or
(i) a VH comprising the amino acid sequence of the VH CDR1, CDR2 and CDR3 of antibody clone number 9 and a VL comprising the VL CDR1, CDR2 and CDR3 of antibody clone number 9; or
(j) a VH comprising the amino acid sequence of the VH CDR1, CDR2 and CDR3 of antibody clone number 10 and a VL comprising the VL CDR1, CDR2 and CDR3 of antibody clone number 10; or
(k) a VH comprising the amino acid sequence of the VH CDR1, CDR2 and CDR3 of antibody clone number 11 and a VL comprising the VL CDR1, CDR2 and CDR3 of antibody clone number 11; or
(l) a VH comprising the amino acid sequence of the VH CDR1, CDR2 and CDR3 of antibody clone number 12 and a VL comprising the VL CDR1, CDR2 and CDR3 of antibody clone number 12; or
(m) a VH comprising the amino acid sequence of the VH CDR1, CDR2 and CDR3 of antibody clone number 13 and a VL comprising the VL CDR1, CDR2 and CDR3 of antibody clone number 13; or
(n) a VH comprising the amino acid sequence of the VH CDR1, CDR2 and CDR3 of antibody clone number 14 and a VL comprising the VL CDR1, CDR2 and CDR3 of antibody clone number 14; or
(o) a VH comprising the amino acid sequence of the VH CDR1, CDR2 and CDR3 of antibody clone number 15 and a VL comprising the VL CDR1, CDR2 and CDR3 of antibody clone number 15; or
(p) a VH comprising the amino acid sequence of the VH CDR1, CDR2 and CDR3 of antibody clone number 16 and a VL comprising the VL CDR1, CDR2 and CDR3 of antibody clone number 16; or
(q) a VH comprising the amino acid sequence of the VH CDR1, CDR2 and CDR3 of antibody clone number 17 and a VL comprising the VL CDR1, CDR2 and CDR3 of antibody clone number 17; or
(r) a VH comprising the amino acid sequence of the VH CDR1, CDR2 and CDR3 of antibody clone number 18 and a VL comprising the VL CDR1, CDR2 and CDR3 of antibody clone number 18; or
(s) a VH comprising the amino acid sequence of the VH CDR1, CDR2 and CDR3 of antibody clone number 19 and a VL comprising the VL CDR1, CDR2 and CDR3 of antibody clone number 19; or
(t) a VH comprising the amino acid sequence of the VH CDR1, CDR2 and CDR3 of antibody clone number 20 and a VL comprising the VL CDR1, CDR2 and CDR3 of antibody clone number 20; or
(u) a VH comprising the amino acid sequence of the VH CDR1, CDR2 and CDR3 of antibody clone number 21 and a VL comprising the VL CDR1, CDR2 and CDR3 of antibody clone number 21; or
(v) a VH comprising the amino acid sequence of the VH CDR1, CDR2 and CDR3 of antibody clone number 22 and a VL comprising the VL CDR1, CDR2 and CDR3 of antibody clone number 22.

The Sequence Table below provides the heavy and light chain variable region sequences of certain disclosed antibodies.

In certain embodiments, a CD39 antibody comprises a VH comprising the amino acid sequence of the VH of any of the CD39 antibodies provided herein. In certain embodiments, a CD39 antibody comprises a VH comprising the amino acid sequence of the VH of any one of the antibody clone numbers 1-22.

In some embodiments, a CD39 antibody comprises the VH of any one of antibody clone numbers 1-22 but with 1, 2, 3, 4, or 5 amino acid substitutions outside the complementarity determining regions (CDRs), such as 1, 2, 3, 4, or 5 conservative substitutions outside the CDRs. In some embodiments, a CD39 antibody comprises the VH of any one of antibody clone numbers 1-22 but with 1, 2, 3, 4, or 5 reversion substitutions outside the complementarily determining regions (CDRs).

In some embodiments, a CD39 antibody comprises the VH of any one of antibody clone numbers 1-22 but with 1, 2, 3, 4, or 5 amino acid substitutions in the framework regions of the VH sequence, such as 1, 2, 3, 4, or 5 conservative substitutions. In some embodiments, a CD39 antibody comprises the VH of any one of antibody clone numbers 1-22 but with 1, 2, 3, 4, or 5 reversion substitutions in the framework regions of the VH sequence.

In some embodiments, a CD39 antibody comprises the VH and VL CDRs of any of the CD39 antibodies described herein, wherein each CDR comprises 0, 1, 2 or 3 amino acid additions, substitutions (e.g., conservative substitutions), or deletions.

In certain embodiments, a CD39 antibody comprises a VH CDR1, CDR2, and CDR3 comprising the amino acid sequences of the VH CDRs of any of the CD39 antibodies provided herein and comprises a VH that is at least 90%, at least 91%, at least 92%, at least 93%, at least 94%, at least 95%, at least 96%, at least 97%, at least 98%, or at least 99% identical to the VH of any of the CD39 antibodies provided herein. In certain embodiments, a CD39 antibody comprises a VH comprising an amino acid sequence that is at least 90%, at least 91%, at least 92%, at least 93%, at least 94%, at least 95%, at least 96%, at least 97%, at least 98%, or at least 99% identical to the amino acid sequence of the VH of any one of antibody clone numbers 1-22. In certain embodiments, the VH of the antibody differs from that of the VH sequences shown in the Sequence Table due to 1, 2, 3, 4, or 5 amino acid substitutions in the framework regions of the VH sequence, such as 1, 2, 3, 4, or 5 conservative substitutions. In certain embodiments, the VH of the antibody differs from that of the VH sequences shown in the Sequence Table due to 1, 2, 3, 4, or 5 reversion substitutions in the framework regions of the VH sequence.

In certain embodiments, a CD39 antibody comprises a VH consisting of the amino acid sequence of the VH of any of the CD39 antibodies provided herein. In certain embodiments, a CD39 antibody comprises a VH that consists of the amino acid sequence of the VH of any one of antibody clone numbers 1-22.

In certain embodiments, a CD39 antibody comprises a VL comprising the amino acid sequence of the VL of any of the CD39 antibodies provided herein. In certain embodiments, a CD39 antibody comprises a VL comprising the amino acid sequence of the VL of any one of antibody clone numbers 1-22. In certain embodiments, a CD39 antibody comprises a VL CDR1, CDR2, and CDR3 comprising the amino acid sequences of the VL CDRs of any of the CD39 antibodies provided herein and comprises a VL that is at least 90%, at least 91%, at least 92%, at least 93%, at least 94%, at least 95%, at least 96%, at least 97%, at least 98%, or at least 99% identical to the VL of any of the CD39 antibodies provided herein. In certain embodiments, a CD39 antibody comprises a VL comprising an amino acid sequence that is at least 90%, at least 91%, at least 92%, at least 93%, at least 94%, at least 95%, at least 96%, at least 97%, at least 98%, or at least 99% identical to the amino acid sequence of the VL of any one of antibody clone numbers 1-22. In certain embodiments, the VL of the antibody differs from that of the VL sequences shown in the Sequence Table due to 1, 2, 3, 4, or 5 amino acid substitutions in the framework regions of the VL sequence, such as 1, 2, 3, 4, or 5 conservative substitutions. In certain embodiments, the VL of the antibody differs from that of the VL sequences shown in the Sequence Table due to 1, 2, 3, 4, or 5 reversion substitutions.

In certain embodiments, a CD39 antibody comprises a VL consisting of the amino acid sequence of the VL of any of the CD39 antibodies provided herein. In certain embodiments, a CD39 antibody comprises a VL that consists of the amino acid sequence of the VL of any one of antibody clone numbers 1-22.

In certain embodiments, a CD39 antibody comprises a VH comprising the amino acid sequence of the VH of any of the CD39 antibodies provided herein and comprises a VL comprising the amino acid sequence of the VL of any of the same CD39 antibodies provided herein. In certain of these embodiments, a CD39 antibody comprises a VH comprising the amino acid sequence of the VH of any one of antibody clone numbers 1-22 and a VL comprising the amino acid sequence of the VL of any one of antibody clone numbers 1-22, optionally wherein the VH and VL are from the same antibody clone number.

In certain embodiments, the VH of the antibody is that of any one of antibody clone numbers 1-22, but with 1, 2, 3, 4, or 5 amino acid substitutions in the framework regions of the VH sequence, such as 1, 2, 3, 4, or 5 conservative substitutions, and the VL is that of any one of the same antibody from the list above. In certain embodiments, however, the VH of the antibody is that of any one of antibody clone numbers 1-22, but with 1, 2, 3, 4, or 5 substitutions in the framework regions of the VH sequence.

In certain embodiments, a CD39 antibody comprises a VH and a VL comprising the amino acid sequences of the VH and VL of any one of antibody clone numbers 1-22.

In certain embodiments, a CD39 antibody comprises a VH CDR1, CDR2, and CDR3 comprising the amino acid sequences of the VH CDRs of any of the CD39 antibodies provided herein as well as a VL CDR1, CDR2, and CDR3 comprising the amino acid sequences of the VL CDRs of any of the CD39 antibodies provided herein, and also comprises a VH and a VL that are each at least 90%, at least 91%, at least 92%, at least 93%, at least 94%, at least 95%, at least 96%, at least 97%, at least 98%, or at least 99% identical to the corresponding VH and VL of any of the CD39 antibodies provided herein. In certain embodiments, the VH and the VL of the antibody differ from the VH and VL sequences shown in the Sequence Table due to 1, 2, 3, 4, or 5 amino acid substitutions in the framework regions of the sequences, such as 1, 2, 3, 4, or 5 conservative substitutions, or such as 1, 2, 3, 4 or 5 reversion substitutions.

In certain embodiments, a CD39 antibody comprises a VH and a VL consisting of the amino acid sequence of the VH and VL of any of the CD39 antibodies provided herein. In certain embodiments, a CD39 antibody comprises a VH and a VL that each consist of the amino acid sequences of the VH and VL of any one of antibody clone numbers 1-22.

A CD39 antibody may comprise:
- (a) a VH comprising the amino acid sequence of the VH of antibody clone number 1 and a VL comprising the amino acid sequence of the VL of antibody clone number 1; or
- (b) a VH comprising the amino acid sequence of the VH of antibody clone number 2 and a VL comprising the amino acid sequence of the VL of antibody clone number 2; or
- (c) a VH comprising the amino acid sequence of the VH of antibody clone number 3 and a VL comprising the amino acid sequence of the VL of antibody clone number 3; or
- (d) a VH comprising the amino acid sequence of the VH of antibody clone number 4 and a VL comprising the amino acid sequence of the VL of antibody clone number 4; or
- (e) a VH comprising the amino acid sequence of the VH of antibody clone number 5 and a VL comprising the amino acid sequence of the VL of antibody clone number 5; or
- (f) a VH comprising the amino acid sequence of the VH of antibody clone number 6 and a VL comprising the amino acid sequence of the VL of antibody clone number 6; or
- (g) a VH comprising the amino acid sequence of the VH of antibody clone number 7 and a VL comprising the amino acid sequence of the VL of antibody clone number 7; or
- (h) a VH comprising the amino acid sequence of the VH of antibody clone number 8 and a VL comprising the amino acid sequence of the VL of antibody clone number 8; or
- (i) a VH comprising the amino acid sequence of the VH of antibody clone number 9 and a VL comprising the amino acid sequence of the VL of antibody clone number 9;
- (j) a VH comprising the amino acid sequence of the VH of antibody clone number 10 and a VL comprising the amino acid sequence of the VL of antibody clone number 10; or
- (k) a VH comprising the amino acid sequence of the VH of antibody clone number 11 and a VL comprising the amino acid sequence of the VL of antibody clone number 11; or
- (l) a VH comprising the amino acid sequence of the VH of antibody clone number 12 and a VL comprising the amino acid sequence of the VL of antibody clone number 12; or
- (m) a VH comprising the amino acid sequence of the VH of antibody clone number 13 and a VL comprising the amino acid sequence of the VL of antibody clone number 13; or
- (n) a VH comprising the amino acid sequence of the VH of antibody clone number 14 and a VL comprising the amino acid sequence of the VL of antibody clone number 14; or
- (o) a VH comprising the amino acid sequence of the VH of antibody clone number 15 and a VL comprising the amino acid sequence of the VL of antibody clone number 15; or
- (p) a VH comprising the amino acid sequence of the VH of antibody clone number 16 and a VL comprising the amino acid sequence of the VL of antibody clone number 16; or
- (q) a VH comprising the amino acid sequence of the VH of antibody clone number 17 and a VL comprising the amino acid sequence of the VL of antibody clone number 17; or
- (r) a VH comprising the amino acid sequence of the VH of antibody clone number 18 and a VL comprising the amino acid sequence of the VL of antibody clone number 18; or
- (s) a VH comprising the amino acid sequence of the VH of antibody clone number 19 and a VL comprising the amino acid sequence of the VL of antibody clone number 19; or
- (t) a VH comprising the amino acid sequence of the VH of antibody clone number 20 and a VL comprising the amino acid sequence of the VL of antibody clone number 20; or
- (u) a VH comprising the amino acid sequence of the VH of antibody clone number 21 and a VL comprising the amino acid sequence of the VL of antibody clone number 21; or
- (v) a VH comprising the amino acid sequence of the VH of antibody clone number 22 and a VL comprising the amino acid sequence of the VL of antibody clone number 22.

A CD39 antibody may comprise:
- (a) a VH comprising the VH CDRs of the VH of antibody clone number 1, and a VL comprising the VL CDRs of antibody clone number 1, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 1; or
- (b) a VH comprising the VH CDRs of the VH of antibody clone number 2, and a VL comprising the VL CDRs of antibody clone number 2, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 2; or
- (c) a VH comprising the VH CDRs of the VH of antibody clone number 3, and a VL comprising the VL CDRs of antibody clone number 3, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 3; or
- (d) a VH comprising the VH CDRs of the VH of antibody clone number 4, and a VL comprising the VL CDRs of antibody clone number 4, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 4; or
- (e) a VH comprising the VH CDRs of the VH of antibody clone number 5, and a VL comprising the VL CDRs of antibody clone number 5, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 5; or
- (f) a VH comprising the VH CDRs of the VH of antibody clone number 6, and a VL comprising the VL CDRs of antibody clone number 6, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 6; or (g) a VH comprising the VH CDRs of the VH of antibody clone number 7, and a VL comprising the VL CDRs of antibody clone number 7, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 7; or (h) a VH comprising the VH CDRs of the VH of antibody clone number 8, and a VL comprising the VL CDRs of antibody clone number 8, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 8; or (i) a VH comprising the VH CDRs of the VH of antibody clone number 9, and a VL comprising the VL CDRs of antibody clone number 9, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 9; or (j) a VH comprising the VH CDRs of the VH of antibody clone number 10, and a VL comprising the VL CDRs of antibody clone number 10, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 10; or (k) a VH comprising the VH CDRs of the VH of antibody clone number 11, and a VL comprising the VL CDRs of antibody clone number 11, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 11; or (l) a VH comprising the VH CDRs of the VH of antibody clone number 12, and a VL comprising the VL CDRs of antibody clone number 12, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 12; or (m) a VH comprising the VH CDRs of the VH of antibody clone number 13, and a VL comprising the VL CDRs of antibody clone number 13, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 13; or (n) a VH comprising the VH CDRs of the VH of antibody clone number 14, and a VL comprising the VL CDRs of antibody clone number 14, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 14; or (o) a VH comprising the VH CDRs of the VH of antibody clone number 15, and a VL comprising the VL CDRs of antibody clone number 15, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 15; or (p) a VH comprising the VH CDRs of the VH of antibody clone number 16, and a VL comprising the VL CDRs of antibody clone number 16, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 16; or (q) a VH comprising the VH CDRs of the VH of antibody clone number 17, and a VL comprising the VL CDRs of antibody clone number 17, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 17; or (r) a VH comprising the VH CDRs of the VH of antibody clone number 18, and a VL comprising the VL CDRs of antibody clone number 18, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 18; or (s) a VH comprising the VH CDRs of the VH of antibody clone number 19, and a VL comprising the VL CDRs of antibody clone number 19, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 19; or (t) a VH comprising the VH CDRs of the VH of antibody clone number 20, and a VL comprising the VL CDRs of antibody clone number 20, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 20; or (u) a VH comprising the VH CDRs of the VH of antibody clone number 21, and a VL comprising the VL CDRs of antibody clone number 21, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 21; or (v) a VH comprising the VH CDRs of the VH of antibody clone number 22, and a VL comprising the VL CDRs of antibody clone number 22, and VH and VL amino acid sequences that are at least 90%, at least 91%, at least 92%, at least 93%, at least 94%, at least 95%, at least 96%, at least 97%, at least 98%, or at least 99% identical to the VH and VL of antibody clone number 22.

In some of the above embodiments, the VH and/or VL may differ from the sequence of each of the species by the presence of 1, 2, 3, 4, or 5 amino acid substitutions, such as 1, 2, 3, 4, or 5 conservative substitutions. In some embodiments, the VH may comprise 1, 2, 3, 4, or 5 reversion substitutions.

A CD39 antibody may comprise:
(a) a VH consisting of the amino acid sequence of the VH of antibody clone number 1 and a VL consisting of the VL of antibody clone number 1; or
(b) a VH consisting of the amino acid sequence of the VH of antibody clone number 2 and a VL consisting of the VL of antibody clone number 2; or
(c) a VH consisting of the amino acid sequence of the VH of antibody clone number 3 and a VL consisting of the VL of antibody clone number 3; or
(d) a VH consisting of the amino acid sequence of the VH of antibody clone number 4 and a VL consisting of the VL of antibody clone number 4; or
(e) a VH consisting of the amino acid sequence of the VH of antibody clone number 5 and a VL consisting of the VL of antibody clone number 5; or
(f) a VH consisting of the amino acid sequence of the VH of antibody clone number 6 and a VL consisting of the VL of antibody clone number 6; or
(g) a VH consisting of the amino acid sequence of the VH of antibody clone number 7 and a VL consisting of the VL of antibody clone number 7; or
(h) a VH consisting of the amino acid sequence of the VH of antibody clone number 8 and a VL consisting of the VL of antibody clone number 8; or
(i) a VH consisting of the amino acid sequence of the VH of antibody clone number 9 and a VL consisting of the VL of antibody clone number 9; or
(j) a VH consisting of the amino acid sequence of the VH of antibody clone number 10 and a VL consisting of the VL of antibody clone number 10; or
(k) a VH consisting of the amino acid sequence of the VH of antibody clone number 11 and a VL consisting of the VL of antibody clone number 11; or
(l) a VH consisting of the amino acid sequence of the VH of antibody clone number 12 and a VL consisting of the VL of antibody clone number 12; or
(m) a VH consisting of the amino acid sequence of the VH of antibody clone number 13 and a VL consisting of the VL of antibody clone number 13; or
(n) a VH consisting of the amino acid sequence of the VH of antibody clone number 14 and a VL consisting of the VL of antibody clone number 14; or
(o) a VH consisting of the amino acid sequence of the VH of antibody clone number 15 and a VL consisting of the VL of antibody clone number 15; or
(p) a VH consisting of the amino acid sequence of the VH of antibody clone number 16 and a VL consisting of the VL of antibody clone number 16; or
(q) a VH consisting of the amino acid sequence of the VH of antibody clone number 17 and a VL consisting of the VL of antibody clone number 17; or
(r) a VH consisting of the amino acid sequence of the VH of antibody clone number 18 and a VL consisting of the VL of antibody clone number 18; or
(s) a VH consisting of the amino acid sequence of the VH of antibody clone number 19 and a VL consisting of the VL of antibody clone number 19; or
(t) a VH consisting of the amino acid sequence of the VH of antibody clone number 20 and a VL consisting of the VL of antibody clone number 20; or
(u) a VH consisting of the amino acid sequence of the VH of antibody clone number 21 and a VL consisting of the VL of antibody clone number 21; or
(v) a VH consisting of the amino acid sequence of the VH of antibody clone number 22 and a VL consisting of the VL of antibody clone number 22.

In certain embodiments, a CD39 antibody comprises any of the variable regions and/or variable region CDRs 1-3 of the antibodies described above and elsewhere herein, such as in the Sequence Table.

In some embodiments, the CD39 antibody is an IgG antibody, such as IgG1, IgG2, IgG3 or IgG4 antibody or a modified form thereof as described in the section below. In some embodiments, the constant region has effector function, and in some embodiments, the constant region is effectorless.

In certain embodiments, a CD39 antibody comprises a heavy chain (HC) comprising the amino acid sequence of the heavy chain of any of the CD39 antibodies provided herein. In certain embodiments, a CD39 antibody comprises a heavy chain comprising the amino acid sequence of the heavy chain of any one of antibody clone numbers 1-22.

In some embodiments, a CD39 antibody may comprise:
(a) a heavy chain comprising the amino acid sequence of the heavy chain of antibody clone number 1 and a light chain comprising the light chain amino acid sequence of antibody clone number 1; or
(b) a heavy chain comprising the amino acid sequence of the heavy chain of antibody clone number 2 and a light chain comprising the light chain amino acid sequence of antibody clone number 2; or
(c) a heavy chain comprising the amino acid sequence of the heavy chain of antibody clone number 3 and a light chain comprising the light chain amino acid sequence of antibody clone number 3; or
(d) a heavy chain comprising the amino acid sequence of the heavy chain of antibody clone number 4 and a light chain comprising the light chain amino acid sequence of antibody clone number 4; or
(e) a heavy chain comprising the amino acid sequence of the heavy chain of antibody clone number 5 and a light chain comprising the light chain amino acid sequence of antibody clone number 5; or
(f) a heavy chain comprising the amino acid sequence of the heavy chain of antibody clone number 6 and a light chain comprising the light chain amino acid sequence of antibody clone number 6; or
(g) a heavy chain comprising the amino acid sequence of the heavy chain of antibody clone number 7 and a light chain comprising the light chain amino acid sequence of antibody clone number 7; or
(h) a heavy chain comprising the amino acid sequence of the heavy chain of antibody clone number 8 and a light chain comprising the light chain amino acid sequence of antibody clone number 8; or
(i) a heavy chain comprising the amino acid sequence of the heavy chain of antibody clone number 9 and a light chain comprising the light chain amino acid sequence of antibody clone number 9; or
(j) a heavy chain comprising the amino acid sequence of the heavy chain of antibody clone number 10 and a light chain comprising the light chain amino acid sequence of antibody clone number 10; or
(k) a heavy chain comprising the amino acid sequence of the heavy chain of antibody clone number 11 and a light chain comprising the light chain amino acid sequence of antibody clone number 11; or (l) a heavy chain comprising the amino acid sequence of the heavy chain of antibody clone number 12 and a light chain comprising the light chain amino acid sequence of antibody clone number 12; or
(m) a heavy chain comprising the amino acid sequence of the heavy chain of antibody clone number 13 and a light chain comprising the light chain amino acid sequence of antibody clone number 13; or
(n) a heavy chain comprising the amino acid sequence of the heavy chain of antibody clone number 14 and a light chain comprising the light chain amino acid sequence of antibody clone number 14; or
(o) a heavy chain comprising the amino acid sequence of the heavy chain of antibody clone number 15 and a light chain comprising the light chain amino acid sequence of antibody clone number 15; or
(p) a heavy chain comprising the amino acid sequence of the heavy chain of antibody clone number 16 and a light chain comprising the light chain amino acid sequence of antibody clone number 16; or
(q) a heavy chain comprising the amino acid sequence of the heavy chain of antibody clone number 17 and a light chain comprising the light chain amino acid sequence of antibody clone number 17; or
(r) a heavy chain comprising the amino acid sequence of the heavy chain of antibody clone number 18 and a light chain comprising the light chain amino acid sequence of antibody clone number 18; or
(s) a heavy chain comprising the amino acid sequence of the heavy chain of antibody clone number 19 and a light chain comprising the light chain amino acid sequence of antibody clone number 19; or
(t) a heavy chain comprising the amino acid sequence of the heavy chain of antibody clone number 20 and a light chain comprising the light chain amino acid sequence of antibody clone number 20; or
(u) a heavy chain comprising the amino acid sequence of the heavy chain of antibody clone number 21 and a light chain comprising the light chain amino acid sequence of antibody clone number 21; or
(v) a heavy chain comprising the amino acid sequence of the heavy chain of antibody clone number 22 and a light chain comprising the light chain amino acid sequence of antibody clone number 22.

A CD39 antibody may comprise:
(a) a heavy chain (HC) comprising the HC CDRs of the HC of antibody clone number 1 and a light chain (LC) comprising the LC CDRs of antibody clone number 1 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 1, respectively; or
(b) a HC comprising the HC CDRs of the HC of antibody clone number 2, and a light chain (LC) comprising the LC CDRs of antibody clone number 2 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 2, respectively; or
(c) a HC comprising the HC CDRs of the HC of antibody clone number 3, and a light chain (LC) comprising the LC CDRs of antibody clone number 3 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 3, respectively; or
(d) a HC comprising the HC CDRs of the HC of antibody clone number 4, and a light chain (LC) comprising the LC CDRs of antibody clone number 4 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 4, respectively; or
(e) a HC comprising the HC CDRs of the HC of antibody clone number 5, and a light chain (LC) comprising the LC CDRs of antibody clone number 5 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 5, respectively; or
(f) a HC comprising the HC CDRs of the HC of antibody clone number 6, and a light chain (LC) comprising the LC CDRs of antibody clone number 6 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 6, respectively; or
(g) a HC comprising the HC CDRs of the HC of antibody clone number 7, and a light chain (LC) comprising the LC CDRs of antibody clone number 7 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 7, respectively; or
(h) a HC comprising the HC CDRs of the HC of antibody clone number 8, and a light chain (LC) comprising the LC CDRs of antibody clone number 8 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 8, respectively; or
(i) a HC comprising the HC CDRs of the HC of antibody clone number 9, and a light chain (LC) comprising the LC CDRs of antibody clone number 9 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 9, respectively; or
(j) a HC comprising the HC CDRs of the HC of antibody clone number 10, and a light chain (LC) comprising the LC CDRs of antibody clone number 10 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 10, respectively; or
(k) a HC comprising the HC CDRs of the HC of antibody clone number 11, and a LC comprising the LC CDRs of antibody clone number 11 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 11, respectively; or (l) a HC comprising the HC CDRs of the HC of antibody clone number 12, and a light chain (LC) comprising the LC CDRs of antibody clone number 12 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 12, respectively; or (m) a HC comprising the HC CDRs of the HC of antibody clone number 13, and a light chain (LC) comprising the LC CDRs of antibody clone number 13 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 13, respectively; or (n) a HC comprising the HC CDRs of the HC of antibody clone number 14, and a light chain (LC) comprising the LC CDRs of antibody clone number 14 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 14, respectively; or (o) a HC comprising the HC CDRs of the HC of antibody clone number 15, and a light chain (LC) comprising the LC CDRs of antibody clone number 15 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 15, respectively; or (p) a HC comprising the HC CDRs of the HC of antibody clone number 16, and a light chain (LC) comprising the LC CDRs of antibody clone number 16 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 16, respectively; or (q) a HC comprising the HC CDRs of the HC of antibody clone number 17, and a light chain (LC) comprising the LC CDRs of antibody clone number 17 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 17, respectively; or (r) a HC comprising the HC CDRs of the HC of antibody clone number 18, and a light chain (LC) comprising the LC CDRs of antibody clone number 18 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 18, respectively; or (s) a HC comprising the HC CDRs of the HC of antibody clone number 19, and a light chain (LC) comprising the LC CDRs of antibody clone number 19 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 19, respectively; or (t) a HC comprising the HC CDRs of the HC of antibody clone number 20, and a light chain (LC) comprising the LC CDRs of antibody clone number 20 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 20, respectively; or (u) a HC comprising the HC CDRs of the HC of antibody clone number 21, and a light chain (LC) comprising the LC CDRs of antibody clone number 21 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 21, respectively; or (v) a HC comprising the HC CDRs of the HC of antibody clone number 22, and a light chain (LC) comprising the LC CDRs of antibody clone number 22 and HC and LC amino acid sequences that are at least 90%, at least 91%, at least 92%, at least 93%, at least 94%, at least 95%, at least 96%, at least 97%, at least 98%, or at least 99% identical to the HC and LC of antibody clone number 22, respectively.

In some of the above embodiments, the HC and/or LC may differ from the sequence of each of the species by the presence of 1, 2, 3, 4, or 5 amino acid substitutions, such as 1, 2, 3, 4, or 5 conservative substitutions. In some of the above embodiments, the HC and/or LC may differ from the sequence of each of the species by the presence of 1, 2, 3, 4, or 5 amino acid substitutions, such as 1, 2, 3, 4, or 5 reversion substitutions.

In certain embodiments, an antibody provided herein is an antibody fragment. Antibody fragments include, but are not limited to, Fab, Fab', Fab'-SH, F(ab')$_2$, Fv, and scFv fragments, and other fragments described below. For a review of certain antibody fragments, see Hudson et al. *Nat. Med.* 9:129-134 (2003). For a review of scFv fragments, see, e.g., Pluckthün, in *The Pharmacology of Monoclonal Antibodies*, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')$_2$ fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., *Nat. Med.* 9:129-134 (2003); and Hollinger et al., *Proc. Natl. Acad. Sci. USA* 90: 6444-6448 (1993). Triabodies and tetrabodies are also described in Hudson et al., *Nat. Med.* 9:129-134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516 B1).

Antibody fragments can be made by various techniques, including but not limited to proteolytic digestion of an intact antibody as well as production by recombinant host cells (e.g. *E. coli* or phage), as described herein.

1. Multispecific Antibodies

In certain embodiments, an antibody provided herein is a multispecific antibody, e.g. a bispecific antibody. Multispecific antibodies are monoclonal antibodies that have binding specificities for at least two different sites. In certain embodiments, one of the binding specificities is for CD39 and the other is for any other antigen. In certain embodiments, one of the binding specificities is for CD39 and the other is for selected independently from one (in the case of bispecific) or more (in the case of multispecific) of PD-1, PD-L1, CTLA-4, Lag-3, TIM-3, A2AR, A2BR, dual A2AR/A2BR, CD40, CD73, TIGIT, CD112R, CD96, PVRL1, PVRL2, PVRL3, PVRL4, CD155, STING, CD47, and IL-27. In certain embodiments, bispecific antibodies may bind to two different epitopes of CD39. Bispecific antibodies may also be used to localize cytotoxic agents to cells which express CD39. Bispecific antibodies can be prepared as full-length antibodies or antibody fragments.

Techniques for making multispecific antibodies include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). Multi-specific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., 1 Immunol., 148(5):1547-1553 (1992)); using "diabody" technology for making bispecific antibody fragments (see, e.g., Hollinger et al., Proc. Natl. Acad. Sci. USA, 90:6444-6448 (1993)); and using single-chain Fv (sFv) dimers (see, e.g. Gruber et al., J. Immunol., 152:5368 (1994)); and preparing trispecific antibodies as described, e.g., in Tutt et al. J. Immunol. 147: 60 (1991).

Engineered antibodies with three or more functional antigen binding sites, including "Octopus antibodies," are also included herein (see, e.g. US 2006/0025576A1).

The antibody or fragment herein also includes a "Dual Acting Fantibody" or "DAF" comprising an antigen binding site that binds to CD39 as well as another, different antigen (see, US 2008/0069820, for example).

2. Antibody Variants

In certain embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

3. Substitution, Insertion, and Deletion Variants

In certain embodiments, antibody variants having one or more amino acid substitutions are provided. Sites of interest for substitutional mutagenesis include the HVRs and FRs. Conservative substitutions are shown in Table 1 as are "exemplary substitutions." Amino acid substitutions may be introduced into an antibody of interest and the products screened for a desired activity, e.g., retained/improved antigen binding, decreased immunogenicity, or improved ADCC or CDC.

TABLE 1

| Original Residue | Exemplary Substitutions | Conservative Substitutions |
| --- | --- | --- |
| Ala (A) | Val; Leu; Ile | Val |
| Arg (R) | Lys; Gln; Asn | Lys |

TABLE 1-continued

| Original Residue | Exemplary Substitutions | Conservative Substitutions |
| --- | --- | --- |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp;Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

Alterations (e.g., substitutions) may be made in HVRs, e.g., to improve antibody affinity. Such alterations may be made in HVR "hotspots," i.e., residues encoded by codons that undergo mutation at high frequency during the somatic maturation process (see, e.g., Chowdhury, Methods Mol. Biol. 207:179-196 (2008)), and/or residues that contact antigen, with the resulting variant VH or VL being tested for binding affinity. Affinity maturation by constructing and reselecting from secondary libraries has been described, e.g., in Hoogenboom et al. in Methods in Molecular Biology 178:1-37 (O'Brien et al., ed., Human Press, Totowa, N.J., (2001).) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more HVRs so long as such alterations do not substantially reduce the ability of the antibody to bind antigen. For example, conservative alterations (e.g., conservative substitutions as provided herein) that do not substantially reduce binding affinity may be made in HVRs. Such alterations may, for example, be outside of antigen contacting residues in the HVRs. In certain embodiments of the variant VH and VL sequences provided above, each HVR either is unaltered, or contains no more than one, two or three amino acid substitutions.

A useful method for identification of residues or regions of an antibody that may be targeted for mutagenesis is called "alanine scanning mutagenesis" as described by Cunningham and Wells (1989) *Science*, 244:1081-1085. In this method, a residue or group of target residues (e.g., charged residues such as arg, asp, his, lys, and glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g. for ADEPT) or a polypeptide which increases the serum half-life of the antibody.

4. Glycosylation Variants

In certain embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody may be made in order to create antibody variants with certain improved properties.

In some embodiments, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e. g. complex, hybrid and high mannose structures) as measured by MALDI-TOF mass spectrometry, as described in WO 2008/077546, for example. Asn297 refers to the asparagine residue located at about position 297 in the Fc region (EU numbering of Fc region residues); however, Asn297 may also be located about ±3 amino acids upstream or downstream of position 297, i.e., between positions 294 and 300, due to minor sequence variations in antibodies. Such fucosylation variants may have improved ADCC function. See, e.g., US Patent Publication Nos. US 2003/0157108 (Presta, L.); US 2004/0093621 (Kyowa Hakko Kogyo Co., Ltd). Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. J. Mol. Biol. 336:1239-1249 (2004); Yamane-Ohnuki et al. *Biotech. Bioeng.* 87: 614 (2004). Examples of cell lines capable of producing defucosylated antibodies include Lec13 CHO cells deficient in protein fucosylation (Ripka et al. *Arch. Biochem. Biophys.* 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (see, e.g., Yamane-Ohnuki et al. *Biotech. Bioeng.* 87: 614 (2004); Kanda, Y. et al., *Biotechnol. Bioeng.*, 94(4):680-688 (2006); and WO2003/085107).

Antibodies variants are further provided with bisected oligosaccharides, e.g., in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

5. Fc Region Variants

In certain embodiments, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In certain embodiments, the invention contemplates an antibody variant that possesses some but not all effector functions, which make it a desirable candidate for applications in which the half-life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assays methods may be employed (see, for example, ACTI™ non-radioactive cytotoxicity assay for flow cytometry (CellTechnology, Inc. Mountain View, Calif.; and CytoTox 96® non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half-life determinations can also be performed using methods known in the art (see, e.g., Petkova, S. B. et al., *Int'l. Immunol.* 18(12):1759-1769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with improved or diminished binding to FcRs are described. (See, e.g., U.S. Pat. No. 6,737,056; WO 2004/056312, and Shields et al., *J. Biol. Chem.* 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 99/51642, and Idusogie et al. *J. Immunol.* 164: 4178-4184 (2000).

Antibodies with increased half-lives and improved binding to the neonatal Fc receptor (FcRn), which is responsible for the transfer of maternal IgGs to the fetus (Guyer et al., *J. Immunol.* 117:587 (1976) and Kim et al., *J. Immunol.* 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 252, 254, 256, 265, 272, 286, 303, 305, 307, 311, 312, 317, 340, 356, 360, 362, 376, 378, 380, 382, 413, 424 or 434, e.g., substitution of Fc region residue 434 (e.g., U.S. Pat. No. 7,371,826). See also Duncan & Winter, *Nature* 322:738-40 (1988); U.S. Pat. Nos. 5,648,260; 5,624,821; and WO 94/29351 concerning other examples of Fc region variants.

In some embodiments, an antibody is provided according to the Table of Sequences, wherein the isotype is human IgG1. In some embodiments, an antibody is provided according to the Table of Sequences, wherein the isotype is human IgG4. In some embodiments, an antibody is provided according to the Table of Sequences, wherein the isotype is human IgG4, wherein there is a single mutation at serine 228 to proline (S228P). In some embodiments, an antibody is provided according to the Table of Sequences, wherein the isotype is human IgG4, wherein there are two mutations at serine 228 to proline (S228P) and leucine 235 to glutamate (L235E). The S228P mutation occurs at position 228 in the literature. The S→P mutation occurs in clones 21 and 22 at position 229 but is still referred to herein as S228P. In some embodiments, the antibody comprises the heavy chain constant region of SEQ ID NO: 40002. In some embodiments, the antibody comprises the heavy chain constant region of SEQ ID NO: 40003.

6. Cysteine Engineered Antibody Variants

In certain embodiments, it may be desirable to create cysteine engineered antibodies, e.g., "thioMantibodies," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described, e.g., in U.S. Pat. No. 7,521,541.

7. Antibody Derivatives

In certain embodiments, an antibody provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide copolymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In some embodiments, the nonproteinaceous moiety is a carbon nanotube (Kam et al., *Proc. Natl. Acad. Sci. USA* 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

B. Recombinant Methods

Antibodies may be produced using recombinant methods and compositions, e.g., as described in U.S. Pat. No. 4,816,567. In some embodiments, an isolated nucleic acid(s) encoding an anti-CD39 antibody described herein is provided. Such nucleic acid(s) may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid(s) are provided. In a further embodiment, a host cell comprising such nucleic acid(s) is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In some embodiments, the host cell is eukaryotic, e.g. a Chinese Hamster Ovary (CHO) cell or lymphoid cell (e.g., Y0, NS0, Sp20 cell). In some embodiments, a method of making an anti-CD39 antibody is provided, wherein the method comprises culturing a host cell comprising a nucleic acid encoding the antibody, as provided above, under conditions suitable for expression of the antibody, and optionally recovering the antibody from the host cell (or host cell culture medium).

For recombinant production of an anti-CD39 antibody, a nucleic acid(s) encoding an antibody, e.g., as described above, is isolated and inserted into one or more vectors for further cloning and/or expression in a host cell. Such nucleic acid(s) may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, *Methods in Molecular Biology*, Vol. 248 (B. K. C. Lo, ed., Humana Press, Totowa, N.J., 2003), pp. 245-254, describing expression of antibody fragments in *E. coli*.) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, *Nat. Biotech.* 22:1409-1414 (2004), and Li et al., *Nat. Biotech.* 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.* 383:44-68 (1982); MRC 5 cells; and FS4 cells. Other useful mammalian host cell lines include Chinese hamster ovary (CHO) cells, including DHFR$^-$ CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antibody production, see, e.g., Yazaki and Wu, *Methods in Molecular Biology*, Vol. 248 (B. K. C. Lo, ed., Humana Press, Totowa, N.J.), pp. 255-268 (2003).

C. Immunoconjugates

The invention also provides immunoconjugates comprising an anti-CD39 antibody herein conjugated to one or more other therapeutic agents or radioactive isotopes.

In another embodiment, an immunoconjugate comprises an antibody as described herein conjugated to a radioactive atom to form a radioconjugate. A variety of radioactive isotopes are available for the production of radioconjugates. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the radioconjugate is used for detection, it may comprise a radioactive atom for scintigraphic studies, for example tc99m or I123, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

Conjugates of an antibody may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., *Science* 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et al., *Cancer Res.* 52:127-131 (1992); U.S. Pat. No. 5,208,020) may be used.

The immunuoconjugates or ADCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A).

D. Pharmaceutical Formulations and Compositions

Pharmaceutical formulations or compositions of an anti-CD39 antibody as described herein are prepared by mixing such antibody having the desired degree of purity with one or more optional pharmaceutically acceptable carriers, diluents, and/or excipients (Remington's Pharmaceutical Sciences 16th edition, Osol, A. Ed. (1980)), in the form of lyophilized formulations or aqueous solutions. Pharmaceutically acceptable carriers, diluents, and excipients are generally nontoxic to recipients at the dosages and concentrations employed, and include, but are not limited to: sterile water, buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer.

The formulation or composition herein may also contain more than one active ingredients as necessary for the particular indication being treated, preferably those with complementary activities that do not adversely affect each other. Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

Sustained-release preparations may be prepared. Suitable examples of sustained-release preparations include semipermeable matrices of solid hydrophobic polymers containing the antibody, which matrices are in the form of shaped articles, e.g. films, or microcapsules.

The formulations or compositions to be used for in vivo administration are generally sterile. Sterility may be readily accomplished, e.g., by filtration through sterile filtration membranes.

E. Therapeutic Methods

Any of the anti-CD39 antibodies provided herein may be used in therapeutic methods. Throughout, where an "antibody" is discussed, it should also be appreciated that a composition comprising the antibody is also encompassed.

In one aspect, an anti-CD39 antibody for use as a medicament is provided. In some embodiments, an anti-CD39 antibody for use in enhancing, increasing and/or sustaining an anti-tumor immune response in a subject having a tumor is provided. In some embodiments, the tumor is cancerous. In some embodiments, an anti-CD39 antibody for use in treating cancer is provided.

In a further aspect, the invention provides for the use of an anti-CD39 antibody in the manufacture or preparation of a medicament. In some embodiments, the medicament is for use in enhancing, increasing and/or sustaining an anti-tumor immune response in a subject having a tumor. In some embodiments, the tumor is cancerous. In some embodiments, the medicament is for treating cancer.

In further aspects, the invention provides methods for treating diseases and/or disorders where reducing or inhibiting the enzymatic activity of CD39 is desired. In some embodiments, methods for enhancing, increasing and/or sustaining an anti-tumor immune response in a subject having a tumor are provided comprising administering an anti-CD39 antibody as described herein. In some embodiments, the tumor is cancerous. In some embodiments, methods for treating cancer in a subject having cancer are provided comprising administering an anti-CD39 antibody as described herein.

In some aspects, the invention provides a method for alleviating one or more symptoms of a CD39 protein associated disease or disorder; or an anti-CD39 antibody or a medicament comprising anti-CD39 antibody for alleviating one or more symptoms of a CD39 protein associated disease or disorder (such as any of the diseases or disorders described herein, for example, cancer). In some aspects, the invention provides a method for reducing the number of symptoms or the severity of one or more symptoms of a CD39 protein associated disease or disorder; or an anti-CD39 antibody or a medicament comprising anti-CD39 antibody for reducing the number of symptoms or the severity of one or more symptoms of a CD39 protein associated disease or disorder (such as any of the diseases or disorders described herein, for example, cancer). In a particular embodiment, the symptom of a CD39 protein associated disease or disorder is a tumor, and a reduction is a reduction in size of a tumor, the failure of the tumor to grow, or the elimination of the tumor.

The antibodies described herein may be used, for example, for treating cancer. In some embodiments, methods for treating cancer are provided, comprising administering an effective amount of an antibody described herein to a subject. In some embodiments, the antibodies may inhibit the growth of at least one tumor in the subject. In some embodiments, methods for inhibiting CD39 in a tissue of a subject having cancer are provided, comprising administering the antibody or composition described herein to the subject, wherein the administration reduces CD39 activity or total amount of CD39 in the tissue as compared to the activity or amount prior to administration. In some embodiments, methods of preventing CD39-mediated conversion of eATP and eADP to extracellular adenosine in a tissue of a subject having cancer are provided, comprising administering the antibody or composition described herein, wherein the administration reduces extracellular adenosine levels within the tumor microenvironment of the tissue. In some embodiments, methods of inhibiting CD39 activity in a tissue of a subject having cancer are provided, comprising administering the antibody or composition described herein, wherein the administration improves the ability to mount an immune response against a tumor cell.

Provided herein are methods for treating a subject having cancer, comprising administering to the subject an effective amount of a CD39 antibody described herein, such that the subject is treated. A CD39 antibody can be used alone. Alternatively, a CD39 antibody can be used in conjunction with another therapy or agent, as described further below.

In some embodiments, the methods for treating a subject having cancer by administration of an anti-CD39 antibody result in infiltration of innate immune cells into the tumor microenvironment. In some embodiments, the infiltration of innate immune cells is greater in a sample from an individual after administration of a therapy e.g., as compared to a sample from an untreated individual. In some embodiments, the infiltration of innate immune cells is greater than the infiltration of innate immune cells from administration of an antagonist of PD-1 (e.g., anti-PD-1 antibody). In some embodiments, the innate immune cells are myeloid cells. In some embodiments, the innate immune cells are tumor-associated macrophages. In some embodiments, the tumor-associated macrophages are positive for expression the F4/80 antigen. In some embodiments, the innate immune cells are NK cells.

Cancers can be cancers with solid tumors or blood malignancies (e.g., liquid tumors). In some embodiments, the cancer is advanced. In some embodiments, the cancer is relapsed. In some embodiments, the cancer is refractory. In some embodiments, the cancer is metastatic. In some embodiments, the cancer is a solid tumor. In some embodiments, the cancer is an advanced solid tumor. In some embodiments, the cancer is a relapsed solid tumor. In some embodiments the cancer is a refractory solid tumor. In some embodiments, the cancer is a metastatic solid tumor. In some embodiments, the cancer is an advanced, relapsed solid tumor. In some embodiments, the cancer is an advanced, refractory solid tumor. In some embodiments, the cancer is an advanced, metastatic solid tumor. In some embodiments, the cancer is a relapsed, refractory solid tumor. In some embodiments, the cancer is a relapsed, metastatic solid tumor. In some embodiments, the cancer is a refractory, metastatic tumor. In some embodiments, the tumor is an advanced, relapsed, refractory solid tumor. In some embodiments, the cancer is an advanced, relapsed, metastatic tumor. In some embodiments, the cancer is an advanced, refractory, metastatic tumor. In some embodiments, the cancer is a relapsed, refractory, metastatic solid tumor. In some embodiments, the tumor is an advanced, relapsed, refractory, metastatic solid tumor.

Non-limiting examples of cancers for treatment include squamous cell carcinoma, small-cell lung cancer, non-small cell lung cancer, squamous non-small cell lung cancer (NSCLC), nonsquamous NSCLC, glioma, gastrointestinal cancer, renal cancer (e.g., clear cell carcinoma), ovarian cancer, liver cancer, colorectal cancer, endometrial cancer, kidney cancer (e.g., renal cell carcinoma (RCC)), prostate cancer (e.g., hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (MO), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B cell lymphomas, T cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T cell lymphoma/leukemia, mantle cell lymphoma, angio immunoblastic T cell lymphoma, angiocentric lymphoma, intestinal T cell lymphoma, primary mediastinal B-cell lymphoma, precursor T-lymphoblastic lymphoma, T-lymphoblastic; and lymphoma/leukaemia (T-Lbly/T-ALL), peripheral T cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T cell and B cell tumors, including but not limited to T cell disorders such as T-prolymphocytic leukemia (T-PLL), including of the small cell and cerebriform cell type; large granular lymphocyte leukemia (LGL) of the T cell type; a/d T-NHL hepatosplenic lymphoma; peripheral/post-thymic T cell lymphoma (pleomorphic and immunoblastic subtypes); angiocentric (nasal) T cell lymphoma; cancer of the head or neck, renal cancer, rectal cancer, cancer of the thyroid gland; acute myeloid lymphoma, as well as any combinations of said cancers. The methods described herein can be used for treatment of metastatic cancers, and/or unresectable cancers, and/or relapsed cancers, and/or refractory cancers, and/or advanced cancers, and/or recurrent cancers. The methods described herein can be used for treatment of pancreatic cancer. The methods described herein can be used for treatment of gastric cancer. The methods described herein can be used for treatment of prostate cancer. The methods described herein can be used for treatment of endometrial cancer. The methods described herein can be used for treatment of non-small cell lung cancer. The methods described herein can be used for treatment of colorectal cancer. The methods described herein can be used for the treatment of ovarian cancer.

In certain embodiments, an antibody described herein is administered to subjects having a cancer that has exhibited an inadequate response to, or progressed on, a prior treatment, e.g., a prior treatment with an immuno-oncology or immunotherapy drug. In some embodiments, the cancer is refractory or resistant to a prior treatment, either intrinsically refractory or resistant (e.g., refractory to a PD-1 pathway antagonist), or a resistance or refractory state is acquired. For example, an antibody described herein may be administered to subjects who are not responsive or not sufficiently responsive to a first therapy or who have disease progression following treatment, e.g., anti-PD-1 pathway antagonist treatment, either alone or in combination with another therapy (e.g., with an anti-PD-1 pathway antagonist therapy). In other embodiments, an antibody described herein is administered to subjects who have not previously received (i.e., been treated with) an immuno-oncology agent, e.g., a PD-1 pathway antagonist.

F. Combinations

Anti-CD39 antibodies can be used either alone or in combination with other therapeutic agents (also sometimes referred to herein as a second therapy). For instance, an anti-CD39 antibody may be used in combination with at least one additional therapeutic agent (e.g., further comprising administering a second therapy, or further comprising administering a second therapy and a third therapy (a triple-combination of cancer therapies)).

In some embodiments, targeting an additional independent inhibitory pathway or combinations thereof has the potential to lead to further enhanced immune cell activation beyond monotherapy.

In some embodiments, methods are provided for enhancing, increasing and/or sustaining an anti-tumor immune response in a subject comprising administering an anti-CD39 antibody to a subject having a tumor, wherein the method further comprises administering a second therapy. In some embodiments, methods are provided for enhancing, increasing and/or sustaining an anti-tumor immune response in a subject comprising administering an anti-CD39 antibody to a subject having a tumor, wherein the method further comprises administering a second therapy and a third therapy.

In some embodiments, methods are provided for treating cancer in a subject comprising administering an anti-CD39 antibody to a subject having cancer, wherein the method further comprises administering a second therapy. In some embodiments, methods are provided for treating cancer in a subject comprising administering an anti-CD39 antibody to a subject having cancer, wherein the method further comprises administering a second therapy and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy and a third therapy.

In some embodiments, methods are provided for enhancing, increasing and/or sustaining an anti-tumor immune response in a subject comprising administering an anti-CD39 antibody to a subject having a tumor, wherein the method further comprises administering a second therapy, wherein the second therapy is an antagonist of PD-1. In some embodiments, methods are provided for enhancing, increasing and/or sustaining an anti-tumor immune response in a subject comprising administering an anti-CD39 antibody to a subject having a tumor, wherein the method further comprises administering an antagonist of PD-1 and a third therapy.

In some embodiments, methods are provided for treating cancer in a subject comprising administering an anti-CD39 antibody to a subject having cancer, wherein the method further comprises administering a second therapy, wherein the second therapy is an antagonist of PD-1. In some embodiments, methods are provided for treating cancer in a subject comprising administering an anti-CD39 antibody to a subject having cancer, wherein the method further comprises administering an antagonist of PD-1 and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an antagonist of PD-1. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an antagonist of PD-1 and a third therapy.

In some embodiments, methods are provided for enhancing, increasing and/or sustaining an anti-tumor immune response in a subject comprising administering an anti- CD39 antibody to a subject having a tumor, wherein the method further comprises administering a second therapy, wherein the second therapy is an antagonist of PD-L1. In some embodiments, methods are provided for enhancing, increasing and/or sustaining an anti-tumor immune response in a subject comprising administering an anti-CD39 antibody to a subject having a tumor, wherein the method further comprises administering an antagonist of PD-L1 and a third therapy.

In some embodiments, methods are provided for treating cancer in a subject comprising administering an anti-CD39 antibody to a subject having cancer, wherein the method further comprises administering a second therapy, wherein the second therapy is an antagonist of PD-L1. In some embodiments, methods are provided for treating cancer in a subject comprising administering an anti-CD39 antibody to a subject having cancer, wherein the method further comprises administering an antagonist of PD-L1 and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an antagonist of PD-L1. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an antagonist of PD-L1 and a third therapy.

In some embodiments, methods are provided for enhancing, increasing and/or sustaining an anti-tumor immune response in a subject comprising administering an anti-CD39 antibody to a subject having a tumor, wherein the method further comprises administering a second therapy, wherein the second therapy is an antagonist of CD73. In some embodiments, methods are provided for enhancing, increasing and/or sustaining an anti-tumor immune response in a subject comprising administering an anti-CD39 antibody to a subject having a tumor, wherein the method further comprises administering an antagonist of CD73 and a third therapy.

In some embodiments, methods are provided for treating cancer in a subject comprising administering an anti-CD39 antibody to a subject having cancer, wherein the method further comprises administering a second therapy, wherein the second therapy is an antagonist of CD73. In some embodiments, methods are provided for treating cancer in a subject comprising administering an anti-CD39 antibody to a subject having cancer, wherein the method further comprises administering an antagonist of CD73 and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an antagonist of CD73. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an antagonist of CD73 and a third therapy.

In some embodiments, methods are provided for enhancing, increasing and/or sustaining an anti-tumor immune response in a subject comprising administering an anti-CD39 antibody to a subject having a tumor, wherein the method further comprises administering a second therapy, wherein the second therapy is an A2AR antagonist, an A2BR antagonist, or a dual A2AR/A2B antagonist. In some embodiments, methods are provided for enhancing, increasing and/or sustaining an anti-tumor immune response in a subject comprising administering an anti-CD39 antibody to a subject having a tumor, wherein the method further comprises administering an A2AR antagonist, an A2BR antagonist, or a dual A2AR/A2B antagonist and a third therapy.

In some embodiments, methods are provided for treating cancer in a subject comprising administering an anti-CD39 antibody to a subject having cancer, wherein the method further comprises administering a second therapy, wherein the second therapy is an A2AR antagonist, an A2BR antagonist, or a dual A2AR/A2B antagonist. In some embodiments, methods are provided for treating cancer in a subject comprising administering an anti-CD39 antibody to a subject having cancer, wherein the method further comprises administering an A2AR antagonist, an A2BR antagonist, or a dual A2AR/A2B antagonist and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an A2AR antagonist, an A2BR antagonist, or a dual A2AR/A2B antagonist. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an A2AR antagonist, an A2BR antagonist, or a dual A2AR/A2B antagonist and a third therapy.

In some embodiments, methods are provided for enhancing, increasing and/or sustaining an anti-tumor immune response in a subject comprising administering an anti-CD39 antibody to a subject having a tumor, wherein the method further comprises administering a second therapy, wherein the second therapy is an antagonist of CD47. In some embodiments, methods are provided for enhancing, increasing and/or sustaining an anti-tumor immune response in a subject comprising administering an anti-CD39 antibody to a subject having a tumor, wherein the method further comprises administering an antagonist of CD47 and a third therapy.

In some embodiments, methods are provided for treating cancer in a subject comprising administering an anti-CD39 antibody to a subject having cancer, wherein the method further comprises administering a second therapy, wherein the second therapy is an antagonist of CD47. In some embodiments, methods are provided for treating cancer in a subject comprising administering an anti-CD39 antibody to a subject having cancer, wherein the method further comprises administering an antagonist of CD47 and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an antagonist of CD47. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an antagonist of CD47 and a third therapy.

In some embodiments, methods are provided for enhancing, increasing and/or sustaining an anti-tumor immune response in a subject comprising administering an anti-CD39 antibody to a subject having a tumor, wherein the method further comprises administering a second therapy, wherein the second therapy is an antagonist of CTLA4. In some embodiments, methods are provided for enhancing, increasing and/or sustaining an anti-tumor immune response in a subject comprising administering an anti-CD39 antibody to a subject having a tumor, wherein the method further comprises administering an antagonist of CTLA4 and a third therapy.

In some embodiments, methods are provided for treating cancer in a subject comprising administering an anti-CD39 antibody to a subject having cancer, wherein the method further comprises administering a second therapy, wherein the second therapy is an antagonist of CTLA4. In some embodiments, methods are provided for treating cancer in a subject comprising administering an anti-CD39 antibody to a subject having cancer, wherein the method further comprises administering an antagonist of CTLA4 and a third therapy.

In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering a second therapy, wherein the second therapy is an antagonist of CTLA4. In some embodiments, methods are provided for inhibiting CD39 in tissue of a subject having cancer comprising administering an anti-CD39 antibody to a subject having cancer, wherein the administration reduces CD39 activity or total amount of CD39 in the tissue as compared to the activity or amount prior to administration, and wherein the method further comprises administering an antagonist of CTLA4 and a third therapy.

In some embodiments, the additional therapeutic agent or second therapy or third therapy is a chemotherapeutic agent, an opsonizing agent, a regulatory T cell ("Treg") depleting agent, an antagonist of a target other than CD39, or an agonist of a target other than CD39. In certain embodiments, the additional therapeutic agent or second therapy or third therapy is a chemotherapeutic agent described herein or any known chemotherapeutic agent. In some embodiments, the additional therapeutic agent or second therapy or third therapy is an opsonizing agent, wherein the opsonizing agent is an antibody other than an anti-CD39 antibody that targets cancer or tumor cells. In some embodiments, the additional therapeutic agent or second therapy or third therapy is a Treg depleting agent described herein or any known Treg depleting agent. In some embodiments, the additional therapeutic agent or second therapy or third therapy is an antagonist of a target other than CD39. In some embodiments, the additional therapeutic agent or second therapy or third therapy is an agonist of a target other than CD39.

In some instances, the additional therapeutic agent or second therapy or third therapy targets an independent inhibitory pathway, such as, for example, a pathway involving PD-1, PD-L1, CTLA-4, Lag-3, TIM-3, A2AR, A2BR, CD40 or CD73. In some embodiments, the additional therapeutic agent or second therapy or third therapy antagonizes one or more of PD-1, PD-L1, CTLA-4, Lag-3, TIM-3, A2AR, A2BR, CD40 or CD73. In some embodiments, the additional therapeutic agent or second therapy or third therapy is an agent targeting the adenosine axis. In some embodiments, the agent targeting the adenosine axis is a CD73 inhibitor. In some embodiments, the agent targeting the adenosine axis is an A2AR, A2BR or dual A2AR/A2BR antagonist. Suitable antagonists for use in the combination therapy described herein, include, without limitation, ligands, antibodies (e.g., monoclonal antibodies and bispecific antibodies), and multivalent agents. In one embodiment, the antagonist is a fusion protein, e.g., an Fc fusion protein, such as AMP-244. In some embodiments, the PD-1 antagonist is an anti-PD-1 or anti-PD-L1 antibody.

In some embodiments, the methods further comprise administering a second therapy, wherein the second therapy is administration of an antagonist of PD-1 (e.g., anti-PD-1 antibody). In some embodiments, the methods result in an increase in interferon gamma (IFN-γ) response in the tumor microenvironment. In some embodiments, the increase in IFN-γ response is greater than the IFN-γ response from administration of the antagonist of PD-1 alone. In some embodiments, the increase in IFN-γ response is greater than the IFN-γ response from a subject that has not received administration of the antagonist of PD-1. In some embodiments, the increase in IFN-γ response is upregulation of interferon gamma (IFN-γ)-related genes in tumor-associated macrophages in the tumor microenvironment. In some embodiments, the increase in IFN-γ response is an increase in IFN-γ protein amount in the tumor microenvironment. In some embodiments, the increase in IFN-γ response is an increase in IFN-γ gene expression in cells isolated from the tumor microenvironment.

In some embodiments, the methods for treating a subject having cancer with an anti-CD39 antibody and an antagonist of PD-1 (e.g., anti-PD-1 antibody) result in infiltration of innate immune cells into the tumor microenvironment. In some embodiments, the infiltration of innate immune cells is greater than the infiltration of innate immune cells from administration of the antagonist of PD-1 alone. In some embodiments, the infiltration of innate immune cells is greater than the infiltration of innate immune cells from a subject that has not received administration of the antagonist of PD-1. In some embodiments, the innate immune cells are myeloid cells. In some embodiments, the innate immune cells are tumor-associated macrophages. In some embodiments, the tumor-associated macrophages are positive for expression the F4/80 antigen. In some embodiments, the innate immune cells are NK cells.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In certain embodiments, an anti-PD-1 antibody is MK-3475 (pembrolizumab) described in WO2012/145493; AMP-514 described in WO 2012/145493; PDR001; BGB-A317 (tislelizumab) and BGB-108; 244C8 and 388D4 as described in WO2016106159; REGN2810; pidilizumab; TSR-042; PF-06801591; or AMP-224. Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 can also be used. An anti-PD-1 antibody that competes for binding with, and/or binds to the same epitope on PD-1 as, as one of these antibodies can also be used in combination treatments.

In some embodiments, the anti-PD-L1 antibody useful for the combination therapy is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943,743. In certain embodiment an anti-PD-L1 antibody is MEDI4736 (also known as durvalumab and Anti-B7-H1), MPDL3280A (also known as atezolizumab and RG7446), MSB0010718C (also known as avelumab; WO2013/79174), FAZ053, MDX1105, or rHigM12B7. Any of the anti-PD-L1 antibodies disclosed in WO2013/173223, WO2011/066389, WO2012/145493, U.S. Pat. Nos. 7,635,757 and 8,217,149 and U.S. Publication No. 2009/145493 can also be used. Anti-PD-L1 antibodies that compete with and/or bind to the same epitope as that of any of these antibodies can also be used in combination treatments.

In certain embodiments, the CD39 antibody of the disclosure can be used with a CTLA-4 antagonist, e.g., an anti-CTLA-4 antibody. In one embodiment, an anti-CTLA-4 antibody is an antibody selected from the group of: Yervoy® (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) Pro. Natl. Acad. Sci. USA 95(17): 10067-10071; Camacho et al. (2004) J. Clin. Oncology 22(145): antibodies tract No. 2505 (antibody CP-675206); and Mokyr et al. (1998) Cancer Res. 58:5301-5304. Any of the anti-CTLA-4 antibodies disclosed in WO2013/173223 can also be used.

In some embodiments, a CD39 antibody of the disclosure is used in combination with a LAG-3 (also referred to herein and by others as LAG3) antagonist. In some embodiments, the LAG-3 inhibitor is selected from the group consisting of LAG525, BMS-986016, and TSR-033. Examples of anti-LAG3 antibodies include antibodies comprising the CDRs or variable regions of antibodies 25F7, 26H10, 25E3, 8B7, 11F2 or 17E5, which are described in U.S. Patent Publication No. US2011/0150892, WO10/19570 and WO2014/008218. In one embodiment, an anti-LAG-3 antibody is BMS-986016. Other art recognized anti-LAG-3 antibodies that can be used include IMP731 and IMP-321, described in US 2011/007023, WO08/132601, and WO09/44273. Anti-LAG-3 antibodies that compete with and/or bind to the same epitope as that of any of these antibodies can also be used in combination treatments.

In some embodiments, a CD39 antibody of the disclosure is used in combination with an adenosine A2AR antagonist, A2BR antagonist or dual A2AR/A2BR antagonists. Examples of A2AR, A2BR and dual A2AR/A2BR antagonists include Preladenant/SCH 420814 (Merck/Schering, CAS Registry Number: 377727-87-2), which is described in Hodgson et al., (2009) J Pharmacol Exp Ther 330(1):294-303 and incorporated herein by reference in its entirety; ST-4206 (Leadiant Biosciences), which is described in U.S. Pat. No. 9,133,197 and incorporated herein by reference in its entirety; KW-6356 (Kyowa Hakko Kogyo), Tozadenant/SYN-115 (Acorda), Istradefylline/KW-6002 (Kyowa Hakko Kogyo, CAS Registry Number: 155270-99-8), which is described in LeWitt et al., (2008) Ann Neurol 63(3):295-302 and is incorporated herein by reference in its entirety; theophylline (CAS Registry Number: 58-55-9), NIR178 (Novartis); AB928 (Arcus Biosciences), GBV-2034 (Globavir), Vipadenant (Redox/Juno), AZD4635/HTL-1071 (AstraZeneca/Heptares), which is described in WO2011/095625 and is incorporated herein by reference in its entirety; CPI-444/V81444 (Corvus/Genentech), which is described in WO 2009/156737 and is incorporated herein by reference in its entirety; PBF509 (Palobiofarma/Novartis), which is described in U.S. Pat. No. 8,796,284 and WO 2017/025918 and are incorporated herein by reference in their entirety; A2AR antagonists described in U.S. Pat. Nos. 8,114,845, 9,029,393, US20170015758, or US20160129108, all of which are incorporated herein by reference in their entirety; and ATL-444, MSX-3, SCH-58261, SCH-412,348, SCH-442,416, VER-6623, VER-6947, VER-7835, CGS-15943, or ZM-241,385.

In some embodiments, a CD39 antibody of the disclosure is used in combination with an adenosine A2BR antagonist. In some embodiments, a CD39 antibody of the disclosure is used in combination with a dual A2AR/A2BR antagonist.

In some embodiments, a CD39 antibody of the disclosure is used in combination with a CD40 inhibitor.

In some embodiments, a CD39 antibody of the disclosure is used in combination with an agent targeting the adenosine axis (e.g., a CD73 inhibitor or a A2AR/A2BR antagonist).

In some embodiments, a CD39 antibody of the disclosure is used in combination with a CD73 inhibitor. Examples of CD73 inhibitors include small molecule CD73 inhibitors such as AB421 (Arcus), a CD73 antibody, or antigen binding portion thereof, that binds to CD73 such as MEDI9447 (Medimmune), BMS-986179 (Bristol Meyers Squibb), or such as described in US2018/0009899 (Corvus), which is incorporated herein by reference in its entirety.

In some embodiments, a CD39 antibody of the disclosure is used in combination with a TIM-3 inhibitor. Examples of TIM-3 inhibitors include MGB453 (Novartis), TSR-022 (Tesaro), or LY3321367 (Eli Lilly). Suitable antagonists for use in the combination therapy described herein, include, without limitation, ligands, antibodies (e.g., monoclonal antibodies and bispecific antibodies), and multivalent agents.

In some embodiments, the one or more additional therapeutic agents is a chimeric antigen receptor (CAR) cell therapy. In some embodiments, the CAR cell therapy is CTL019.

In some embodiments, members of the PVR gene family are upregulated on tumor cells and can exhibit intrinsic tumor-promoting properties. Therefore, in some embodiments, the second therapy is selected from one or more of an antagonist of TIGIT, CD112R, CD96, PVRL1, PVRL2, PVRL3, PVRL4, and CD155. Suitable antagonists for use in the combination therapy described herein, include, without limitation, ligands, antibodies (e.g., monoclonal antibodies and bispecific antibodies), and multivalent agents.

STING agonists induce innate immune cell activation resulting in increased T cell priming and recruitment of immune cells into the tumor microenvironment. Targeting STING agonists in combination with CD39 has the potential to lead to an even further increase in T cell and NK cell recruitment and activation.

Increased anti-CD47 antibody mediated phagocytosis can lead to an increase in the presentation of cancer derived antigens by macrophages to T cells. Combination treatment with an anti-CD47 antibody and an anti-CD39 antibody, such as an anti-CD39 antibody provided herein provides an opportunity to enhance cancer antigen specific T cell responses and is fully encompassed herein.

In some embodiments, the additional therapeutic agent or second therapy or third therapy is an antagonist of CD47. In some embodiments, the antagonist of CD47 is an anti-CD47 antibody. The anti-CD47 antibody may comprise SEQ ID NO: 40004 (heavy chain comprising a wild-type human IgG4 constant) and SEQ ID NO: 40005 (light chain). In some embodiments, the anti-CD47 antibody comprises: (a) HCDR1 comprising the amino acid sequence of SEQ ID NO: 40006; (b) HCDR2 comprising the amino acid sequence of SEQ ID NO: 40007; (c) HCDR3 comprising the amino acid sequence of SEQ ID NO: 40008; (d) LCDR1 comprising the amino acid sequence of SEQ ID NO: 40009; (e) LCDR2 comprising the amino acid sequence of SEQ ID NO: 40010; and (f) LCDR3 comprising the amino acid sequence of SEQ ID NO: 40011. See U.S. Pat. No. 9,803,016 (e.g., SEQ ID NOs: 24 and 26), herein incorporated in its entirety by reference.

The antibodies herein may also be provided before, substantially contemporaneous with, or after other therapies, for example, surgery, chemotherapy, radiation therapy, or the administration of a biologic, such as another therapeutic antibody. In some embodiments where e.g., two therapies are administered or a triple-combination of cancer therapies is administered, the therapies may be administered concurrently, consecutively, and/or at different points in time according to their own dosing schedule. In some embodiments, the cancer has recurred or progressed following a therapy selected from surgery, chemotherapy, and radiation therapy, or a combination thereof. For example, a CD39 antibody as described herein could be administered as adjunctive therapy when there is a risk that micrometastases can be present and/or in order to reduce the risk of a relapse.

In some embodiments, a chemotherapeutic agent is used in combination with an anti-CD39 antibody described herein. Exemplary chemotherapeutic agents include, but are not limited to, anthracyclines (e.g., doxorubicin, idarubicin, daunorubicin, cytarabine, epirubicin, valrubicin and mitoxantrone) (see e.g., Minotti et al., (2004) Pharmacol Rev 56(2):185-229), topoisomerase inhibitors (e.g., topotecan; Hycamtin, camptothecin, etoposide) (see e.g., Pommier et al., (2010) Chem Biol 17(5):421-433; which is incorporated herein by reference in its entirety), bleomycin (Kimura et al., (1972) Cancer 29(1):58-60), gemcitabine (Plunkett et al., (1995) Semin Oncol 22(4 Suppl 11):3-10), platins (e.g., carboplatin, cisplatin, oxaliplatin, satraplatin, picoplatin) (Kelland (2007) Nat Rev Cancer 7(8):573-584), taxanes (e.g., docetaxel, paclitaxel, abraxane) (Abal et al., (2003) Curr Cancer Drug Targets 3(3):193-203) (including albumin-bound versions of taxanes (e.g., albumin-bound paclitaxel), DNA alkylating agents (eg. cyclophosphamide, bendamustine) (Leoni et al., (2008) Clin Cancer Res 14(1):309-317), CHOP (drug combination of cyclophosphamide, doxorubicin hydrochloride, vincristine and prednisone) (Dunleavy (2014) Hematology Am Soc Hematol Educ Program 2014(1):107-112), and fluorouracil and derivatives thereof (Alvarez et al., (2012) Expert Opin Ther Pat 22(2): 107-123, which is incorporated herein by reference in its entirety).

In some embodiments, the chemotherapeutic agent induces immunogenic cell death (ICD). In some embodiments, the agent that induces ICD is an anthracycline. In some embodiments, the anthracycline is selected from doxorubicin, daunorubicin, epirubicin, idarubicin, and valrubicin. In some embodiments, the anthracycline is doxorubicin. In some embodiments, the agent that induces ICD is a platinum derivative. In some embodiments, the platinum derivative is selected from oxaliplatin, carboplatin, and cisplatin. In some embodiments, the platinum derivative is oxaliplatin.

Other chemotherapeutic agents suitable for combination and/or co-administration with compositions of the present invention include, for example: taxol, cytochalasin B, gramicidin D, ethidium bromide, emetine, mitomycin, etoposide, tenoposide, vincristine, vinblastine, colchicin, doxorubicin, daunorubicin, dihydroxyanthrancindione, mitoxantrone, mithramycin, actinomycin D, 1-dehydrotestosterone, glucocorticoids, procaine, tetracaine, lidocaine, propranolol, and puromycin and analogs or homologs thereof. Further agents include, for example, antimetabolites (e.g., methotrexate, 6-mercaptopurine, 6-thioguanine, cytarabine, 5-fluorouracil decarbazine), alkylating agents (e.g. mechlorethamine, thioTEPA, chlorambucil, melphalan, carmustine (BSNU), lomustine (CCNU), cyclophosphamide, busulfan, dibromomannitol, streptozotocin, mitomycin C, cis-dichlordiamine platinum (II)(DDP), procarbazine, altretamine, cisplatin, carboplatin, oxaliplatin, nedaplatin, satraplatin, or triplatin tetranitrate), anthracycline (e.g. daunorubicin (formerly daunomycin) and doxorubicin), antibiotics (e.g. dactinomcin (formerly actinomycin), bleomycin, mithramycin, and anthramycin (AMC)), and antimitotic agents (e.g. vincristine and vinblastine) and temozolomide.

For treatment of cancer, the combinations may be administered in conjunction with one or more additional anti-cancer agents, such as a chemotherapeutic agent, growth inhibitory agent, anti-cancer vaccine such as a gene therapy vaccine, anti-angiogenesis agent and/or anti-neoplastic composition.

In some embodiments, an anti-inflammatory drug may be administered with the combination, such as a steroid or a non-steroidal anti-inflammatory drug (NSAID). In cases where it is desirable to render aberrantly proliferative cells quiescent in conjunction with or prior to treatment with CD39 antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyl-testosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX®, can also be administered to the subject. When employing the methods or compositions described herein, other agents used in the modulation of tumor growth or metastasis in a clinical setting, such as antimimetics, can also be administered as desired.

Such combination therapies noted above encompass combined administration (where two or three or more therapeutic agents are included in the same or separate formulations or compositions), and separate administration, in which case, administration of the anti-CD39 antibody can occur prior to, simultaneously, and/or following, administration of the additional therapeutic agent or agents. In some embodiments, administration of the anti-CD39 antibody and administration of an additional therapeutic agent occur within about one month, or within about one, two or three weeks, or within about one, two, three, four, five, or six days, of each other.

An anti-CD39 antibody (and any additional therapeutic agent) can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. Dosing can be by any suitable route, e.g. by injections, such as intravenous or subcutaneous injections, depending in part on whether the administration is brief or chronic. Various dosing schedules including but not limited to single or multiple administrations over various time-points, bolus administration, and pulse infusion are contemplated herein.

Anti-CD39 antibodies (and secondary antibody therapies) can be formulated, dosed, and administered in a fashion consistent with good medical practice. Factors for consideration in this context include the particular disorder being treated, the particular mammal being treated, the clinical condition of the individual subject, the cause of the disorder, the site of delivery of the agent, the method of administration, the scheduling of administration, and other factors known to medical practitioners. As used herein, a "split dose" is the division of single unit dose or total daily dose into two or more doses, e.g., two or more administrations of the single unit dose. The antibody may be administered as "split dose."

The antibody need not be but is optionally formulated with one or more agents currently used to prevent or treat the disorder in question. The effective amount of such other agents depends on the amount of antibody present in the formulation or composition, the type of disorder or treatment, and other factors discussed above. These are generally used in the same dosages and with administration routes as described herein, or about from 1 to 99% of the dosages described herein, or in any dosage and by any route that is empirically/clinically determined to be appropriate. In some embodiments, the antibody is provided in a formulation for immediate release and the other agent is formulated for extended release or vice versa.

G. Articles of Manufacture

In another aspect, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is an antibody. The label or package insert indicates that the composition is used for treating the condition of choice. Moreover, the article of manufacture may comprise (a) a first container with a composition contained therein, wherein the composition comprises an anti-CD39 antibody; and (b) a second container with a composition contained therein, wherein the composition comprises a further cytotoxic or otherwise therapeutic agent. The article of manufacture in this embodiment may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

It is understood that any of the above articles of manufacture may include an immunoconjugate in place of or in addition to an anti-CD39 antibody.

IV. EXAMPLES

Example 1. Anti-CD39 Antibody Generation

CD39 antigens (recombinant CD39; R&D systems cat #4397-EN) were biotinylated using the EZ-Link Sulfo-NHS-Biotinylation Kit from Pierce. Goat F(ab')$_2$ anti-human kappa-FITC (LC-FITC), ExtrAvidin-PE (EA-PE) and Streptavidin-AF633 (SA-633) were obtained from Southern Biotech, Sigma, and Molecular Probes, respectively. Streptavidin MicroBeads and MACS LC separation columns were purchased from Miltenyi Biotec. Goat anti-human IgG-PE (Human-PE) was obtained from Southern Biotech.

Primary Discovery.

Eight naïve human synthetic yeast libraries each of ~$10^9$ diversity were propagated as previously described (see, e.g., Y. Xu et al, Addressing polyspecificity of antibodies selected from an in vitro yeast presentation system: a FACS-based, high-throughput selection and analytical tool. PEDS 26.10, 663-70 (2013); WO2009036379; WO2010105256; and WO2012009568.) For the first two rounds of selection, a magnetic bead sorting technique utilizing the Miltenyi MACS system was performed, as previously described (see, e.g., Siegel et al, "High efficiency recovery and epitope-specific sorting of an scFv yeast display library." J Immunol Methods 286(1-2), 141-153 (2004).) Briefly, yeast cells (~$10^{10}$ cells/library) were incubated with 1.5 ml of 10 nM biotinylated Fc-fusion antigen for 15 min at 30° C. in wash buffer (phosphate-buffered saline (PBS)/0.1% bovine serum albumin (BSA)). After washing once with 40 ml ice-cold wash buffer, the cell pellet was resuspended in 20 mL wash buffer, and Streptavidin MicroBeads (500 µl) were added to the yeast and incubated for 15 min at 4° C. Next, the yeast were pelleted, resuspended in 20 mL wash buffer, and loaded onto a Miltenyi LS column. After the 20 mL were loaded, the column was washed 3 times with 3 mL wash buffer. The column was then removed from the magnetic field, and the yeast were eluted with 5 mL of growth media and then grown overnight. The following rounds of selection were performed using flow cytometry. Approximately 2×$10^7$ yeast were pelleted, washed three times with wash buffer, and incubated at 30° C. with either decreasing concentrations of biotinylated antigen (200 to 5 nM) under equilibrium conditions, or with a poly-specificity depletion reagent (PSR) to remove non-specific antibodies from the selection. For the PSR depletion, the libraries were incubated with a 1:10 dilution of biotinylated PSR reagent as previously described (see, e.g., Y. Xu et al, Addressing polyspecificity of antibodies selected from an in vitro yeast presentation system: a FACS-based, high-throughput selection and analytical tool. PEDS 26.10, 663-70 (2013).) Yeast were then washed twice with wash buffer and stained with LC-FITC (diluted 1:100) and either SA-633 (diluted 1:500) or EAPE (diluted 1:50) secondary reagents for 15 min at 4° C. After washing twice with wash buffer, the cell pellets were resuspended in 0.3 mL wash buffer and transferred to strainer-capped sort tubes.

Sorting was performed using a FACS ARIA sorter (BD Biosciences) and sort gates were determined to select for antibodies with desired characteristics. Selection rounds were repeated until a population with all of the desired characteristics was obtained. After the final round of sorting, yeast were plated and individual colonies were picked for characterization.

Light Chain Batch Shuffle.

Light chain diversification protocol was used during the primary discovery phase for further discovery and improvement of antibodies.

Light chain batch diversification protocol: Heavy chains from a naïve selection output were extracted from the yeast via PCR and transformed into a light chain library with a diversity of 5×10$^6$. Selections were performed with one round of MACS and three rounds of FACS as described in the naïve discovery. In the different FACS rounds the libraries were looked at for PSR binding, and affinity pressure by antigen titration. Sorting was performed in order to obtain a population with the desired characteristics.

Antibody Affinity Maturation

Affinity maturation of antibodies was performed by introducing diversities into the heavy chain variable regions as described below.

CDRH1 and CDRH2 selection: The CDRH3 of a single antibody was recombined into a premade library with CDRH1 and CDRH2 variants of a diversity of 1×10$^8$ and selections were performed with one round of MACS and three rounds of FACS as described in the naïve discovery. In the different FACS rounds the libraries were looked at for PSR binding, mouse cross-reactivity, and affinity pressure by titration or affinity pressure by pre-complexing the antigen with parental Fab or parental IgG to enrich for binders with higher affinity than the parental IgG. Sorting was performed in order to obtain a population with the desired characteristics.

Antibody Production and Purification

Yeast clones were grown to saturation and then induced for 48 hours at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect (GE Healthcare LifeSciences).

Clones 1-20 are IgG1 antibodies (the sequence of the human IgG1 constant region is shown as SEQ ID NO: 40000). Clones 21-22 are IgG4 antibodies with a single point mutation S228P (the sequence of human IgG4 constant region with the S228P mutation is shown as SEQ ID NO: 40002). Clone 22 differs from clone 21 by a single amino acid (K in clone 21, R in clone 22) in the VH FR4. In general, antibodies using the heavy constant regions of SEQ ID NO:40002 (S228P mutation), SEQ ID NO: 40003 (S228P and L235E), SEQ ID NO: 40000 (IgG1 wildtype) and SEQ ID NO: 40001 (IgG4 wildtype) may also be referred to by clone number and -A, -B, -C, and -D, respectively. In general, all exemplified antibodies described herein comprise the human kappa light chain.

The heavy chain and light chain protein sequences of clone 21 are shown as SEQ ID NOs: 20019 and 20021, respectively. The heavy chain and light chain nucleotide sequences of clone 21 are shown as SEQ ID NOs: 20020 and 20022, respectively.

The heavy chain and light chain protein sequences of clone 22 are shown as SEQ ID NOs: 30019 and 30021, respectively. The heavy chain and light chain nucleotide sequences of clone 22 are shown as SEQ ID NOs: 30020 and 30022, respectively.

Example 2. Anti-CD39 Antibodies Bind to Human Cancer Cells

To determine the relative extent of binding of anti-CD39 antibodies to cells, MOLP-8 or SK-MEL-28 cells were treated with two concentrations of fluorescently-labeled anti-CD39 antibodies or a control IgG1 antibody, as indicated in FIGS. 1A, 1B, 1C, 1D. The extent of binding to cells was determined and expressed as mean fluorescent intensity (MFI). Cells were washed with FACS Buffer (2 mM EDTA, 2% FBS) and pelleted by centrifugation. The cells were resuspended in FACS buffer containing a dose of anti-CD39 or control IgG1 antibody directly labelled with fluorophore Alexa Fluor 488 (AF488) and incubated for 30 minutes at room temperature. Cells were then washed twice with FACS buffer followed by fixation in 4% paraformaldehyde (PFA) and resuspended in FACS buffer and analyzed on a FACS Canto II analyzer (BD Biosciences).

Figure 1C:
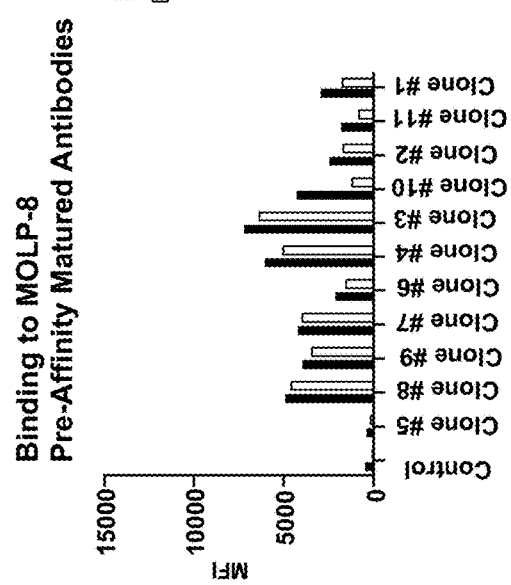
FIGS. 1A, 1B, 1C, and 1D depict the ability of anti-CD39 antibodies at two concentrations, as compared to a control IgG1 antibody, to bind to SK-MEL-28 cells (FIGS. 1A and 1B) and MOLP-8 cells (FIGS. 1C and D).
Figure 1D:
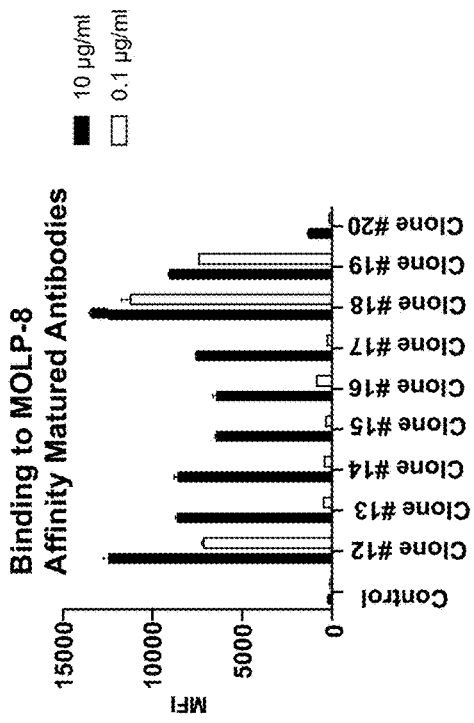
Figure 1A:
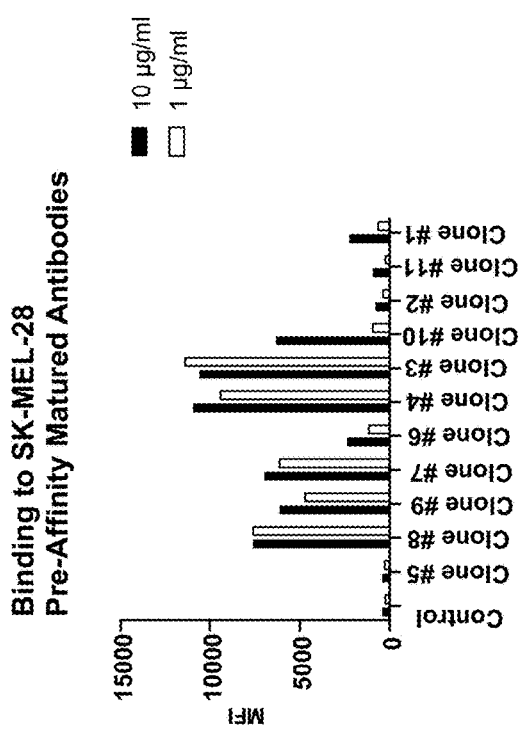
Figure 1B:
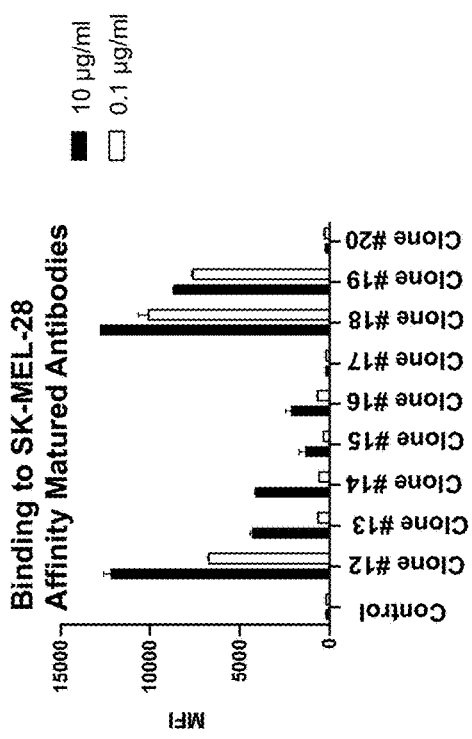

As shown in FIG. 1A (pre-affinity matured antibodies) and FIG. 1B (affinity matured antibodies) bound to SK-MEL-28 cells. As shown in FIG. 1C (pre-affinity matured antibodies) and FIG. 1D (affinity matured antibodies) bound to MOLP-8 cells.

Example 3. Anti-CD39 Antibodies Inhibit CD39 Activity on Malignant and Immune Cells The ability of anti-CD39 antibodies to inhibit the enzymatic activity of CD39 on malignant cell lines and primary immune cells was measured using a malachite green phosphate assay. Briefly, cells were treated for 60 min. with anti-CD39 antibodies or control antibody and 25 μM ATP. Release of inorganic phosphate from ATP was measured using a malachite green phosphate assay kit (Enzo Life Sciences, Catalog #BML-AK111). Normalized percent inhibition (% INH) was determined using 'time zero control' to represent 100% inhibition and a 'no antibody control' to represent 0% INH. The 'time zero control' is a well with all of the reagents where the reaction is stopped immediately to mimic conditions where no phosphate is generated and CD39 is completely inhibited. The 'no antibody control' is a well where all of the reagents and cells are added but no antibodies are present. This well mimics conditions where the maximal amount of phosphate is released and there is no inhibition of CD39. To determine percent inhibition: the 'no antibody control' value is subtracted from the assay value and divided by the 'no antibody control' value subtracted from the 'time zero control' value. The resulting value is multiplied by 100 to give a percentage value. MOLP-8 (human multiple myeloma cell line), SK-MEL-28, primary human B cells (isolated from whole blood), or primary human monocytes (isolated from whole blood) were used in this assay.

Figure 2A:
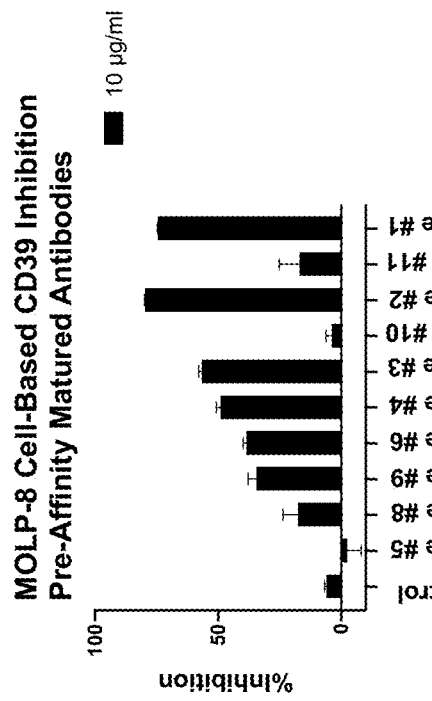
FIGS. 2A, 2B, 2C, and 2D depict the ability of anti-CD39 antibodies, as compared to a control IgG1 antibody, to inhibit the enzymatic activity of CD39 in SK-MEL-28 cells (FIGS. 2A and 2B) and MOLP-8 cells (FIGS. 2C and 2D).
Figure 2B:
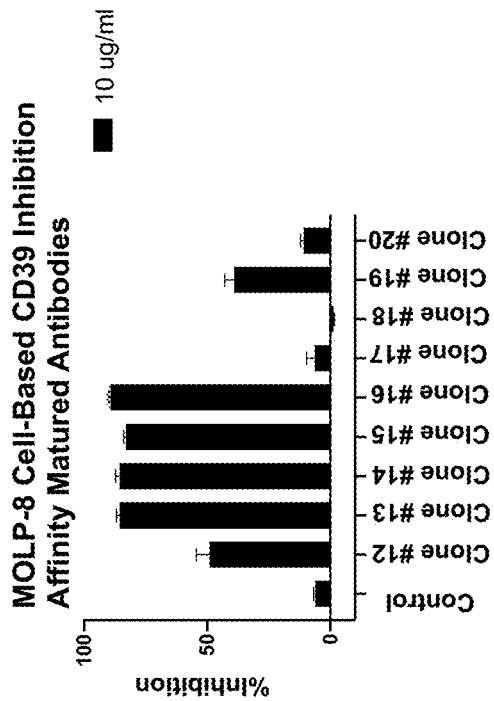

As shown in FIG. 2A (pre-affinity matured antibodies) and FIG. 2B (affinity matured antibodies), treatment of SK-MEL-28 cells with 10 μg/mL of anti-CD39 antibodies or control IgG1 antibody, as indicated, resulted in inhibition of CD39 enzymatic activity.

Figure 2C:
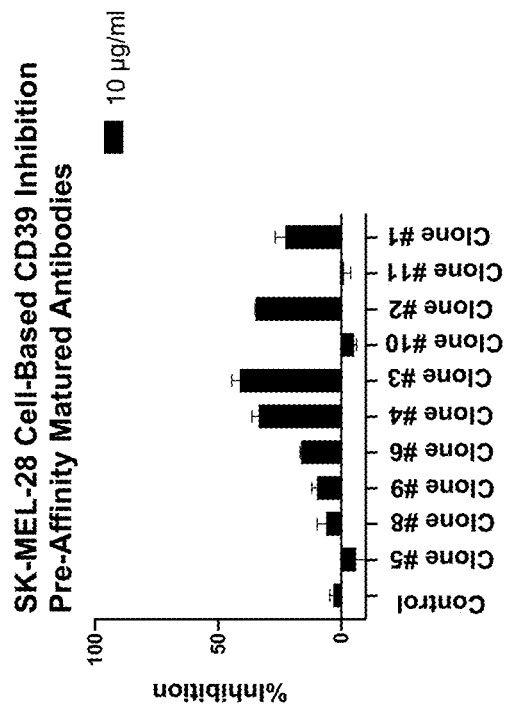
Figure 2D:
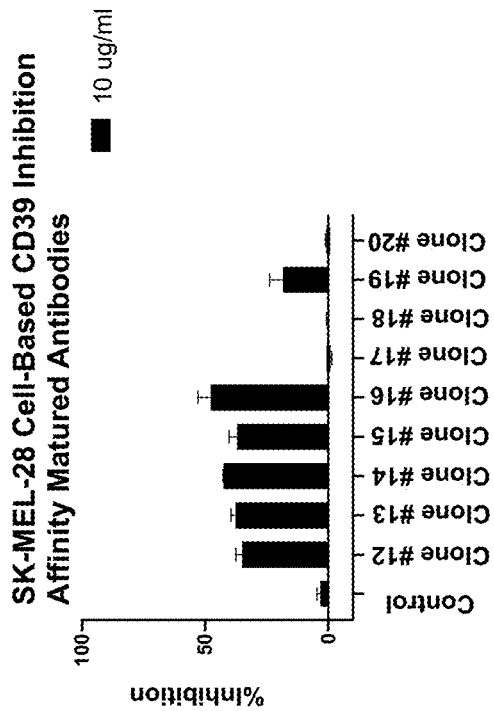

As shown in FIG. 2C (pre-affinity matured antibodies) and FIG. 2D (optimized antibodies), treatment of MOLP-8 cells with 10 µg/mL of anti-CD39 antibodies or control IgG1 antibody, as indicated, resulted in inhibition of CD39 enzymatic activity.

Figure 3A:
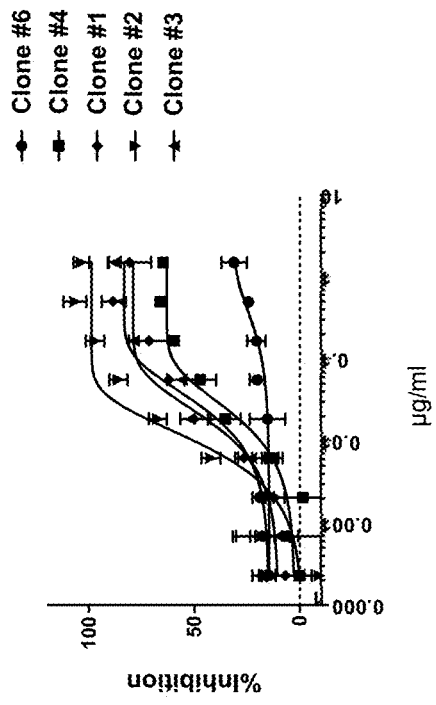
FIGS. 3A, 3B, and 3C depict the ability of anti-CD39 antibodies over a dose range, as compared to a control IgG1 antibody, to inhibit the enzymatic activity of CD39 in SK-MEL-28 cells (FIG. 3C) and MOLP-8 cells (FIGS. 3A and 3B).
Figure 3C:
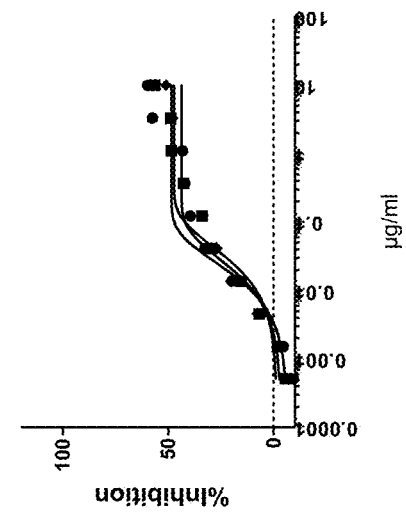
Figure 3B:
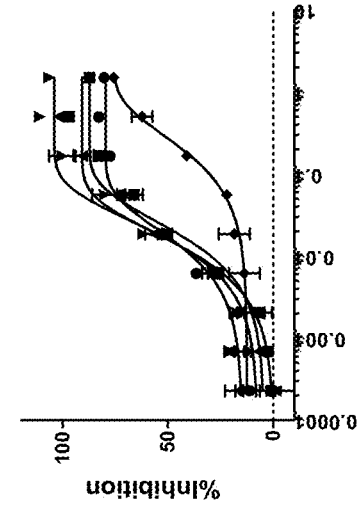

As shown in FIG. 3A (pre-affinity matured antibodies) and FIG. 3B (affinity matured antibodies), treatment of MOLP-8 cells with a range of concentrations of anti-CD39 antibodies or control IgG1 antibody (DNP-C), as indicated, in the presence of ATP resulted in a dose-dependent inhibition of CD39 activity by all anti-CD39 antibodies tested. Inhibition of CD39 activity was determined by the extent of inorganic phosphate released and expressed as % inhibition (% INH).

As shown in FIG. 3C (affinity matured antibodies IgG4 with a single mutation at serine 228 to proline (S228P), designated clones 16-A, 14-A, and 13-A), treatment of SK-MEL-28 cells with a range of concentrations of anti-CD39 antibodies or control IgG4 antibody comprising the same single mutation at serine 228 to proline (S228P) (DNP.41), as indicated, in the presence of ATP resulted in a dose-dependent inhibition of CD39 activity. Inhibition of CD39 activity was determined by the extent of inorganic phosphate released and expressed as % inhibition (% INH).

As shown in FIG. 4A (pre-affinity matured antibodies) and FIG. 4B (affinity matured antibodies), treatment of primary human monocytes isolated from whole blood with a range of concentrations of anti-CD39 antibodies or control IgG1 antibody (DNP-C), as indicated, in the presence of ATP resulted in a dose-dependent inhibition of CD39 activity. Inhibition of CD39 activity was determined by the extent of inorganic phosphate released and expressed as % inhibition (% INH).

As shown in FIG. 4C (pre-affinity matured antibodies) and FIG. 4D (affinity matured antibodies), treatment of primary human B cells isolated from whole blood with a range of concentrations of anti-CD39 antibodies or a control IgG1 antibody (DNP-C), as indicated, in the presence of ATP resulted in a dose-dependent inhibition of CD39 activity. Inhibition of CD39 activity was determined by the extent of inorganic phosphate released and expressed as % inhibition (% INH).

Taken together, these results demonstrate that treatment of malignant and primary immune cells with anti-CD39 antibodies inhibits CD39 enzymatic activity.

Example 4. Binding Affinities of Anti-CD39 Antibodies

The binding affinities of certain anti-CD39 antibodies (clones 1-20) were determined by measuring their kinetic constants ($k_a$, $k_d$, $K_D$) using a ForteBio Octet RED384 (Pall Forte Bio Corporation, Menlo Park, Calif.) generally as previously described (Estep et al. (2013) Mabs 5(2):270-278, which is incorporated herein by reference in its entirety).

Briefly, ForteBio affinity measurements were performed by loading IgGs on-line onto AHQ sensors. Sensors were equilibrated off-line in assay buffer for 30 min and then monitored on-line for 60 seconds for baseline establishment. Sensors with loaded IgGs were exposed to 100 nM antigen for 3 minutes, and afterwards were transferred to assay buffer for 3 minutes for off-rate measurement. All kinetics were analyzed using the 1:1 binding model. Carrier free human CD39-His lacking transmembrane domains was used as the antigen (R&D Systems Cat: 4397-EN-010).

Equilibrium affinity measurements performed as previously described (Estep et al., (2013) Mabs 5(2):270-278). Solution equilibrium titrations (SET) were performed in PBS+0.1% IgG-Free BSA (PBSF) with antigen held constant at 10-100 pM and incubated with 3-to 5-fold serial dilutions of antibody starting at 5-100 nM (experimental conditions are sample dependent). Antibodies (20 nM in PBS) were coated onto standard-bind MSD-ECL plates overnight at 4° C. or at room temperature for 30 minutes. Plates were then blocked for 30 min with shaking at 700 rpm, followed by three washes with wash buffer (PBSF+ 0.05% Tween 20). SET samples were applied and incubated on the plates for 150 seconds with shaking at 700 rpm followed by one wash. Antigen captured on a plate was detected with 250 ng/mL sulfotag-labeled streptavidin in PBSF by incubation on the plate for 3 min. The plates were washed three times with wash buffer and then read on the MSD Sector Imager 2400 instrument using 1× Read Buffer T with surfactant. The percent free antigen was plotted as a function of titrated antibody in Graphpad Prism and fit to a quadratic equation to extract the KD. To improve throughput, liquid handling robots were used throughout MSD-SET experiments, including SET sample preparation. Carrier free human CD39-His lacking transmembrane domains was biotinylated and used as the antigen (R&D Systems Cat: 4397-EN-010). Fortebio and MSD affinity measurements for the anti-CD39 antibodies are provided in FIG. 5.

Next, association and dissociation of clone 22 to recombinant human, mouse, rat, and cynomolgus monkey CD39 was assessed using a Biolayer interferometry (BLI) assay, which is a label-free technology utilizing an optical analytical technique that analyzes the interference pattern of white light reflected from two surfaces. Changes in the number of molecules bound to the biosensor causes a shift in the interference pattern that is measured in real time. The current analysis used 2 different biosensor configurations to determine the binding affinities of recombinant CD39 from human, mouse, rat, and cynomolgus monkey to clone 22.

In the first configuration, an Anti-Human Immunoglobulin G (IgG) Fragment Crystallizable (Fc) Capture (AHC) biosensor was used first to capture 1 µg/mL of clone 22 as the ligand onto 8 biosensors and subsequently to measure association (600 s) and dissociation (900 s) of 0 to 5 µg/mL of recombinant CD39 from either human, rat, or cynomolgus monkey as the analyte. A second configuration was required for recombinant mouse CD39 binding analysis, as the positive control antibody was a rat IgG and would not bind to the AHC biosensor. Recombinant mouse CD39 binding to clone 22 was analyzed with this second configuration to achieve a direct comparison with the positive control antibody. An Amine Reactive Second-Generation (AR2G) biosensor was used to first bind 20 µg/mL of clone 22 or Duha59 positive control antibody (ligand) to the surface of the biosensor by crosslinking primary amines on the protein in a 96-well plate format onto 8 biosensors. Subsequently, association (600 s) and dissociation (1200 s) of recombinant mouse CD39 (analyte) was measured at a concentration range of 0 to 5.0 µg/mL for both antibodies. The AR2G biosensor configuration included a prerequisite load scouting experiment to determine optimal conditions (pH 5.0 or 6.0) for coupling of the antibodies to the biosensor. The optimal pH for loading of both clone 22 and the Duha59 positive control antibodies was pH 6.0. Under both configurations, association constants ($k_a$) and dissociation constants ($k_d$) were determined and $K_D$ was calculated for each antibody where binding of the analyte was observed (clone 22 with recombinant CD39 from both human and cynomolgus monkey and Duha59 positive control antibody with recombinant mouse CD39). Kinetic binding parameters were not determined for interactions where binding was not observed (clone 22 with recombinant CD39 from both mouse and rat).

Results of the association and dissociation of recombinant human, mouse, rat, and cynomolgus monkey CD39 at concentrations ranging from 0 to 1.25 µg/mL with clone 22 concentration of 1.0 µg/mL for human, rat, and cynomolgus monkey and 20 µg/mL for mouse are shown in FIGS. 13A-E. Final binding kinetic parameters ($K_D$, $k_a$, and $k_d$) are shown in Table 2 along with binding model fit parameters ($R^2$ and $\chi^2$) that demonstrate goodness of the model fitting to the data. Higher analyte concentrations of 2.5 and 5.0 µg/mL (35.7 and 71.4 nM, respectively, for human and cynomolgus monkey recombinant CD39) were well above the KD for the 1:1 binding interaction (0.4 to 1.11 nM) and displayed non-specific effects that were not indicative of the binding interaction with clone 22. Thus, these higher analyte concentrations were not included for the calculation of $K_D$.

TABLE 2

| Recombinant Analyte | Ligand | $K_D$ (M) | $k_d$ (1/M · s) | $k_a$ (1/s) | Full χ2 | Full R$_2$ |
|---|---|---|---|---|---|---|
| human CD39 | Clone 22 | 1.11E−09 | 5.19E−04 | 4.67E+05 | 0.5093 | 0.9878 |
| mouse CD39 | Clone 22 | | | N/A | | |
| mouse CD39 | Duha59 | 1.09E−09 | 1.39E−03 | 1.28E+06 | 0.6137 | 0.9834 |
| rat CD39 | Clone 22 | | | N/A | | |
| cynomolgus monkey CD39 | Clone 22 | 4.06E−10 | 3.05E−04 | 7.51E+05 | 0.3215 | 0.9953 |

Abbreviations:
Duha59 = rat anti-mouse CD39 Duha59 clone,
$k_a$ = association constant,
$k_d$ = dissociation constant,
$K_D$ = binding affinity,
N/A = not applicable,
rhCD39 = recombinant human CD39
Note:
R2 values > 0.95 and χ2 values < 3.0 are demonstrative of a good fit of the model to the data.

Figure 13A:
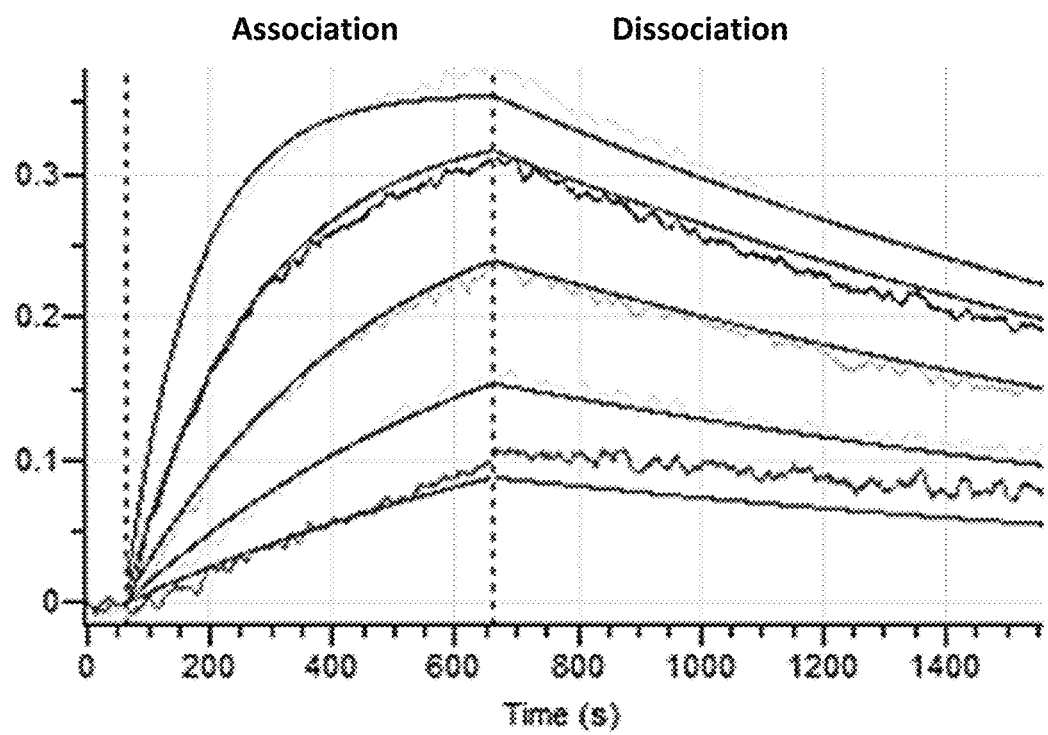
FIGS. 13A, 13B, 13C, 13D, and 13E show binding data for clone 22. Binding sensorgrams for recombinant human CD39 binding to clone 22 (FIG. 13A), mouse CD39 binding to clone 22 (FIG. 13B), mouse CD39 binding to Duha59 (FIG. 13C), rat CD39 binding to clone 22 (FIG. 13D), and cynomolgus monkey CD39 binding to clone 22 (FIG. 13E). Each trace represents increasing concentrations of the recombinant CD39 analyte that have been subtracted from the reference trace. Solid lines indicate global fitting of the 1:1 binding model (pseudo-first-order kinetics) of analyte and ligand (recombinant CD39: clone 22 or Duha59). Vertical dotted lines indicate the start of association and dissociation, respectively, for the recombinant CD39 analyte.
Figure 13B:
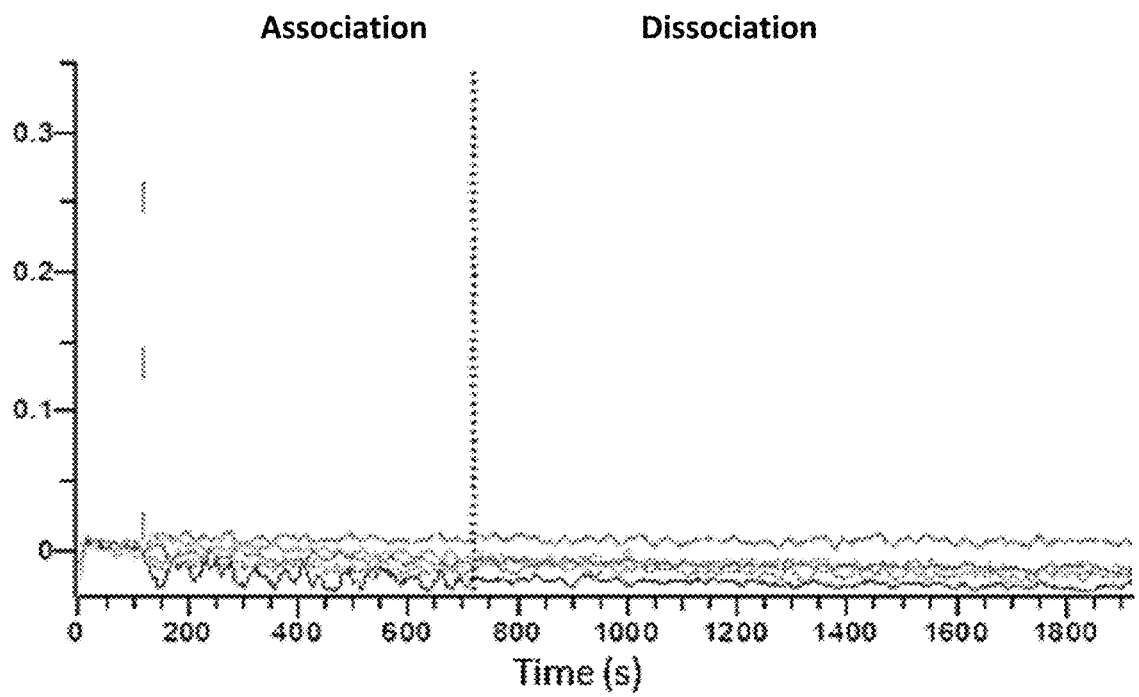
Figure 13C:
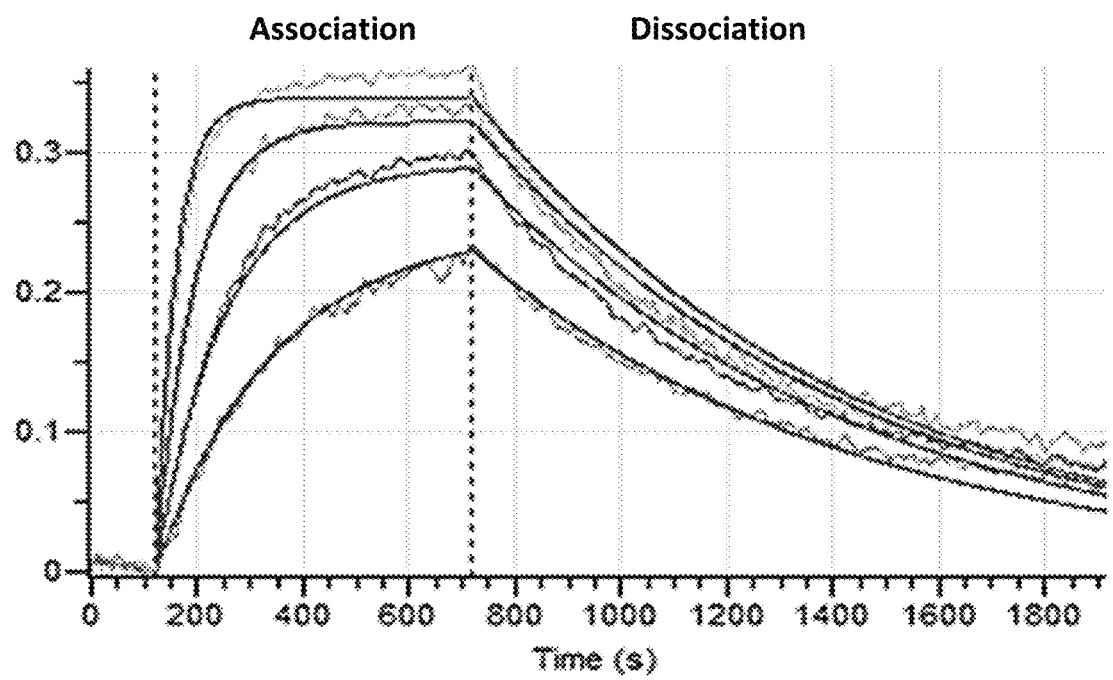
Figure 13D:
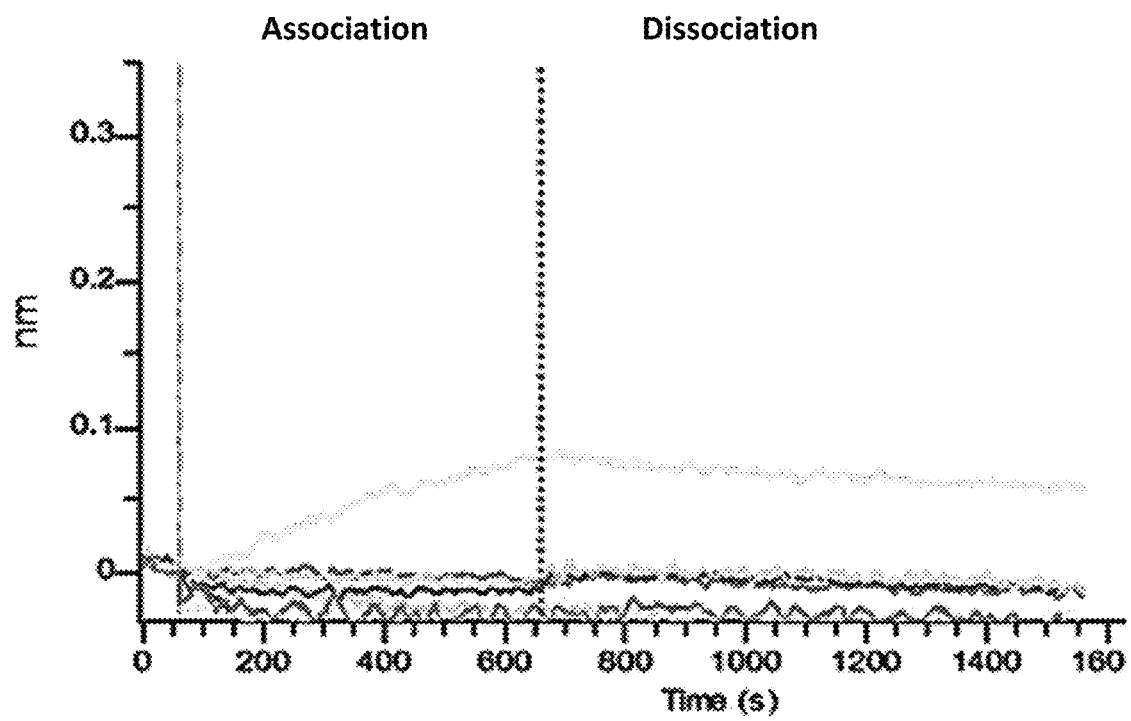
Figure 13E:
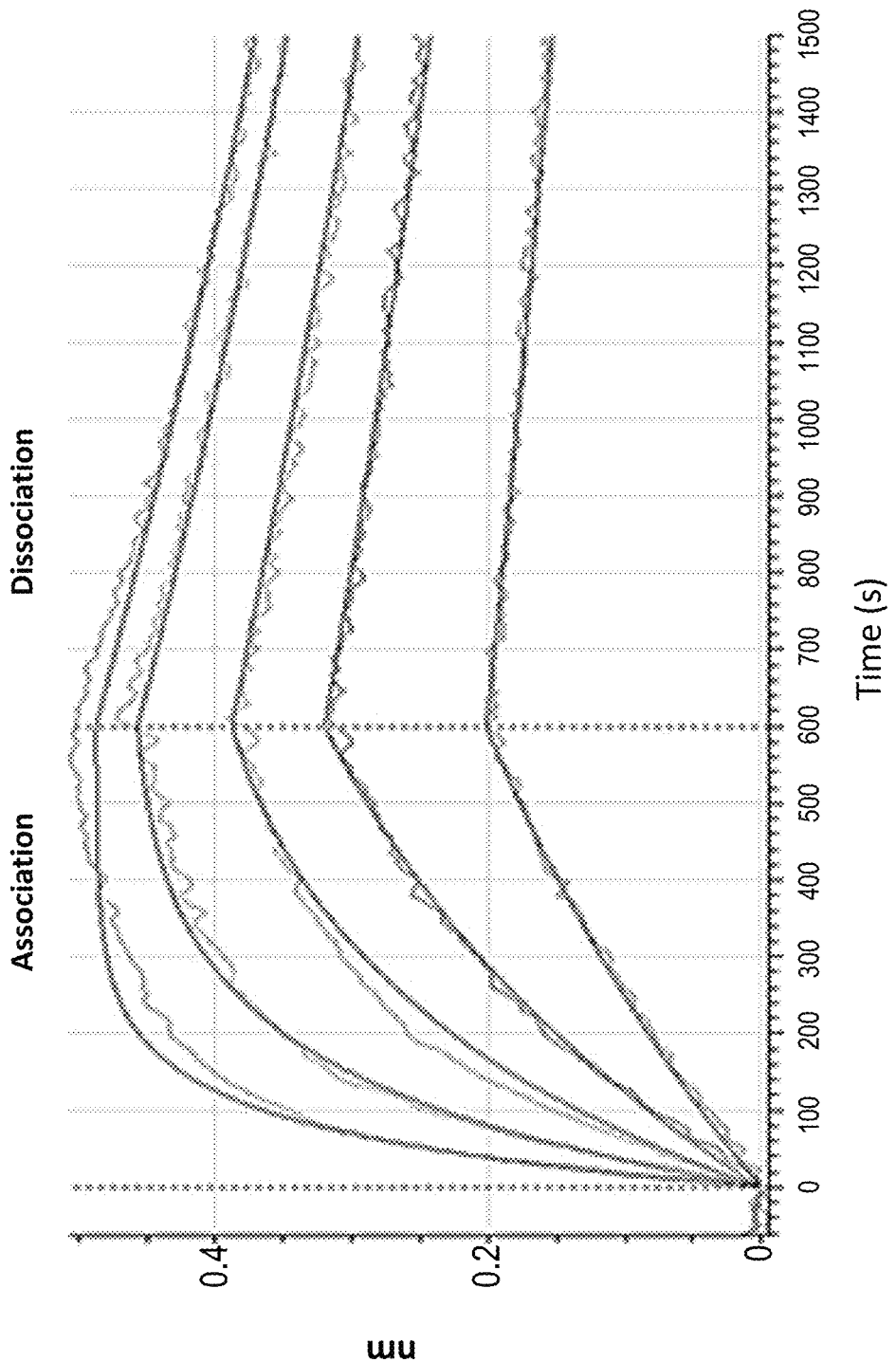

Recombinant human and cynomolgus monkey CD39 both displayed strong binding affinity as measured by $K_D$ for clone 22 (1.11 and 0.41 nM, respectively). Recombinant mouse and rat CD39 did not bind to clone 22, indicated by the no response observed for the binding sensorgrams (FIG. 13B and FIG. 13D). Binding kinetic parameters were not determined for either recombinant rat or mouse CD39 as a result. Recombinant mouse CD39 did demonstrate good binding affinity as measured by $K_D$ (1.09 nM) to the Duha59 positive control antibody.

As shown in FIGS. 13A-13E, clone 22 has strong binding affinity as measured by $K_D$ for recombinant human CD39 (rhCD39) ($K_D$=1.11 nM). Analysis of species cross-reactivity for mouse, rat, and cynomolgus monkey showed that clone 22 also has high affinity for recombinant cynomolgus monkey CD39 ($K_D$=0.41 nM), but does not bind to recombinant mouse or rat CD39.

Example 5: Anti-CD39 Antibodies Increase CD4+ T Cell Proliferation

Figure 6A:
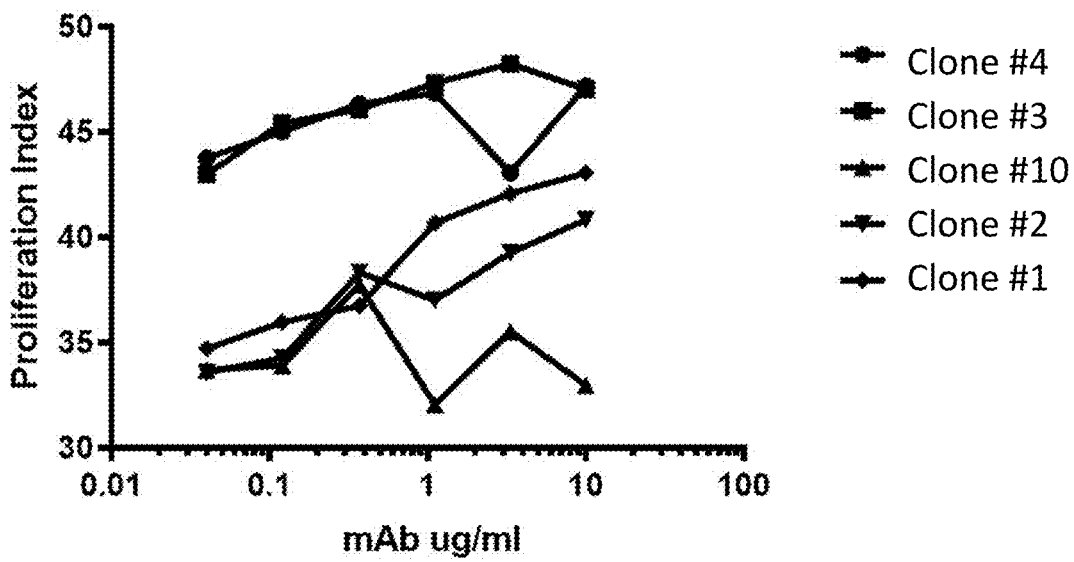
FIGS. 6A and 6B show the ability of anti-CD39 to increase proliferation of CD4+ T cells from human PBMCs in response to treatment with a range of concentrations for naïve (FIG. 6A) and affinity matured (FIG. 6B) antibodies.
Figure 6B:
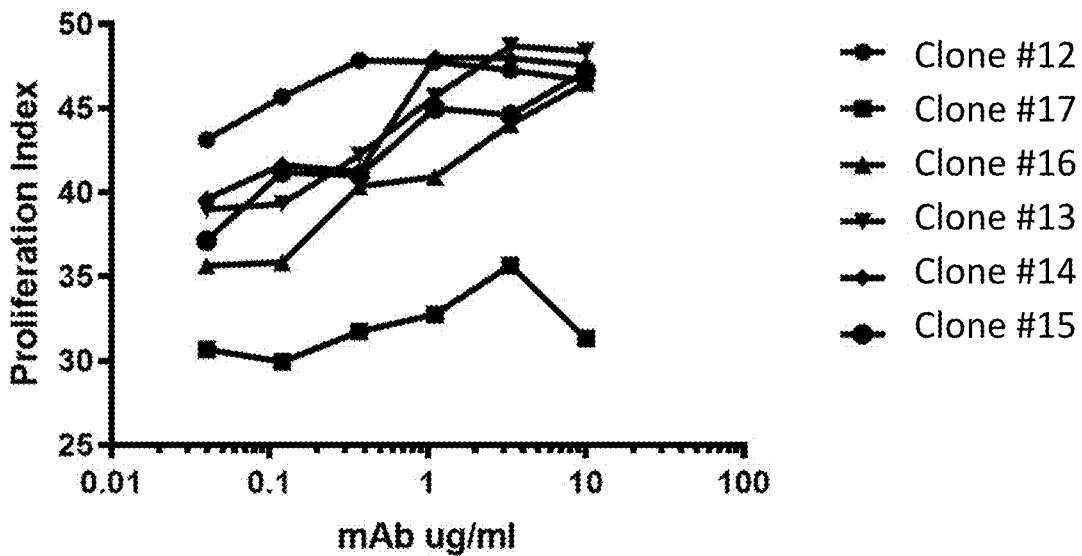

To determine an effect of treatment with anti-CD39 antibodies on CD4+ T cells, the amount of proliferation of CD4+ T cells in vitro in response to treatment with a range of concentrations of anti-CD39 antibodies, as indicated, or control IgG1 antibody (DNP-C) was determined. CD4+ cells from freshly PBMCs from human donor blood were stained with cell trace violet stain prior to seeding in 96-well plates. Cells were incubated with 250 µM ATP, anti-CD3/CD28 beads to stimulate the T-cells, and anti-CD39 or control IgG1 antibody, as indicated, for 3 days, and the proliferation index for each antibody treatment was quantitated by flow cytometry by measuring the amount of cell trace violet remaining in the cells. Cells were also stained for CD4 to confirm T-cell lineage. As shown in FIG. 6A (pre-affinity matured antibodies) and FIG. 6B (affinity matured antibodies), the proliferation index of CD4+ T-cells in response to ATP is increased in the presence of anti-CD39 antibodies.

Figure 7A:
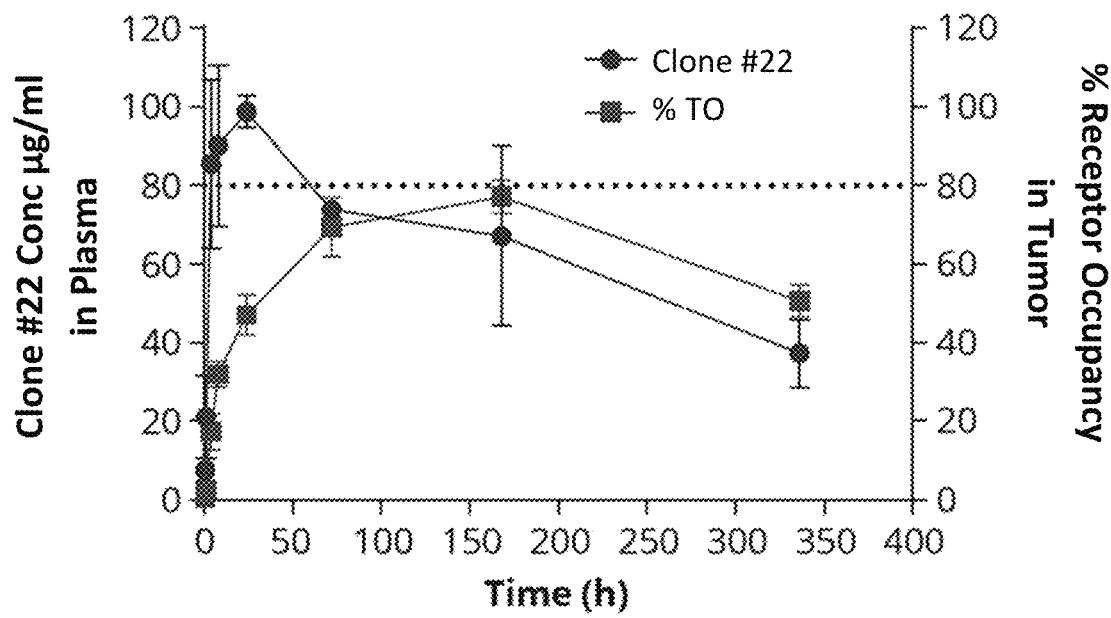
FIGS. 7A and 7B show treatment of the MOLP-8 xenograft model in mice with clone 22 leads to tumor growth inhibition, depicting plasma levels of clone 22 and percent (%) Target Occupancy (TO) (FIG. 7A) and tumor volume (FIG. 7B).
Figure 7B:
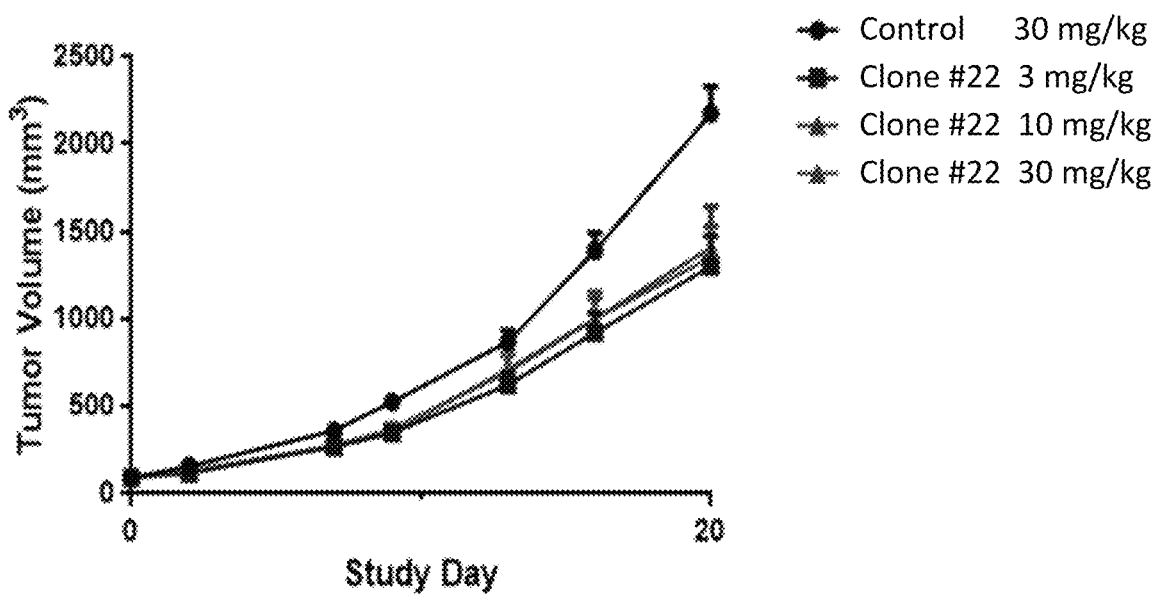

Example 6: Treatment with Anti-CD39 Antibody Leads to Tumor Growth Inhibition in MOLP-8 Xenograft Model in Mice SCID mice were injected with MOLP-8 tumor cells subcutaneously. At day 14, mice (n=10-11 mice/group) were treated once intraperitoneally with 10 mg/kg clone 22. At indicated time points plasma levels of clone 22 were determined by ELISA (FIG. 7A). Tumors were dissociated to single cell suspensions, split, and dosed with 1 mg/mL clone 22 and AF647-IgG4 (fluorescently labeled anti-IgG4 antibody to detect clone 22) or directly stained with AF647-IgG4. Percent (%) target occupancy (TO) was calculated using flow cytometry. The % TO (mean±SEM) from cells treated with AF647-IgG4 at indicated time points is shown in FIG. 7A. Five to 7-week-old female SCID mice were injected with MOLP-8 tumor cells subcutaneously into the right flank and randomized into 4 treatment groups when tumors reached a mean volume of approximately 100 mm³. The groups (n=10-11 mice/group) were treated IP with either 30 mg/kg control IgG4 antibody with a single point mutation at serine 228 to proline (DNP.41) or 3, 10, or 30 mg/kg clone 22 twice a week for 3 weeks. Tumors were measured in 2 dimensions using a caliper twice a week and tumor volumes were calculated. Data are shown as mean±SEM in FIG. 7B.

Figure 8A:
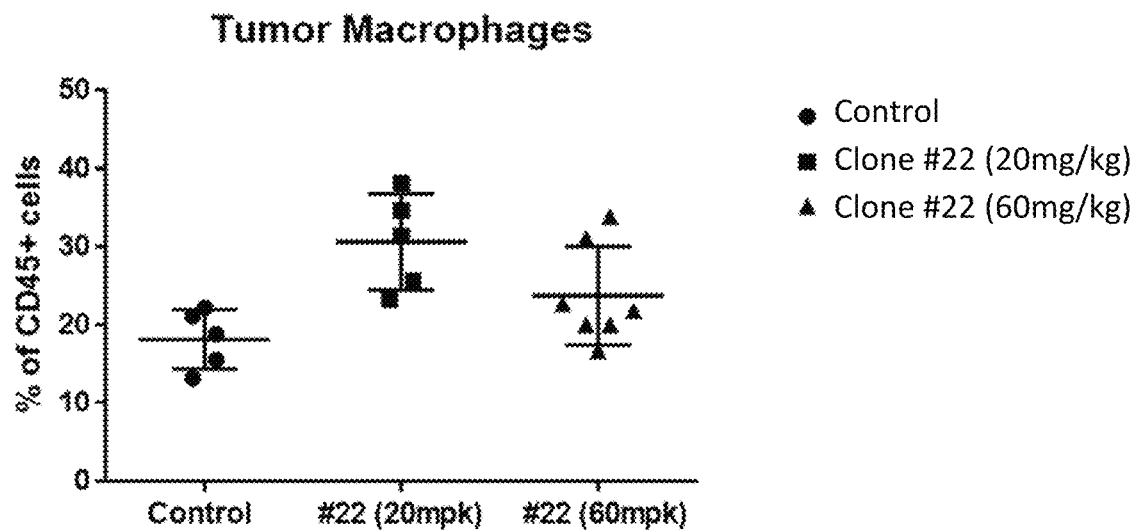
FIGS. 8A, 8B, 8C, and 8D show treatment of MOLP-8 xenograft model in mice with clone 22 leads to increased macrophage infiltration in tumors as demonstrated by flow cytometry (FIG. 8A) and immunohistochemistry staining (FIG. 8B and FIG. 8C), and reduced tumor volume (FIG. 8D).
Figure 8B:
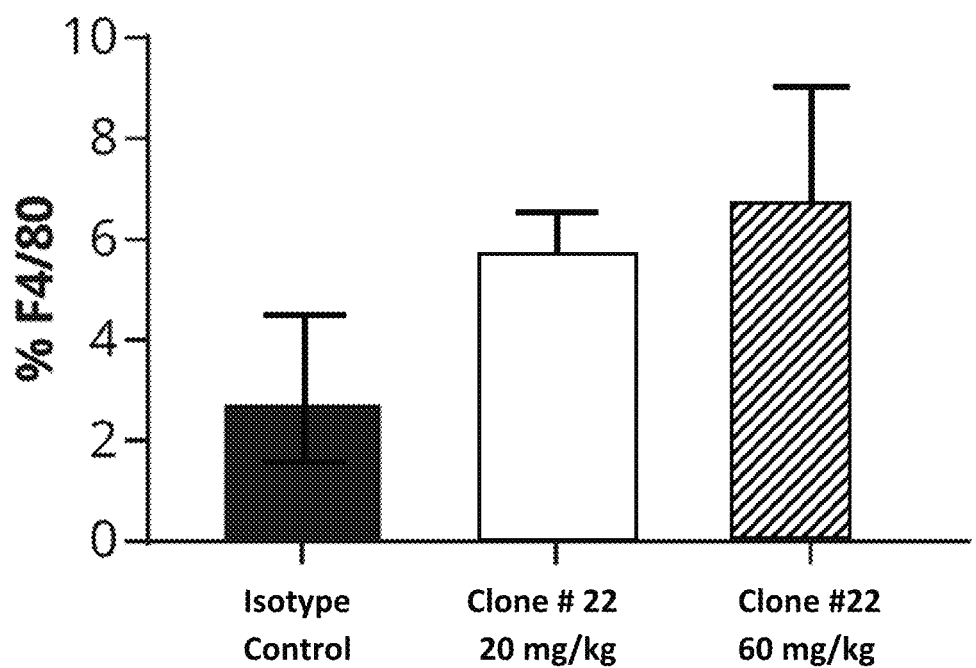
Figure 8C:
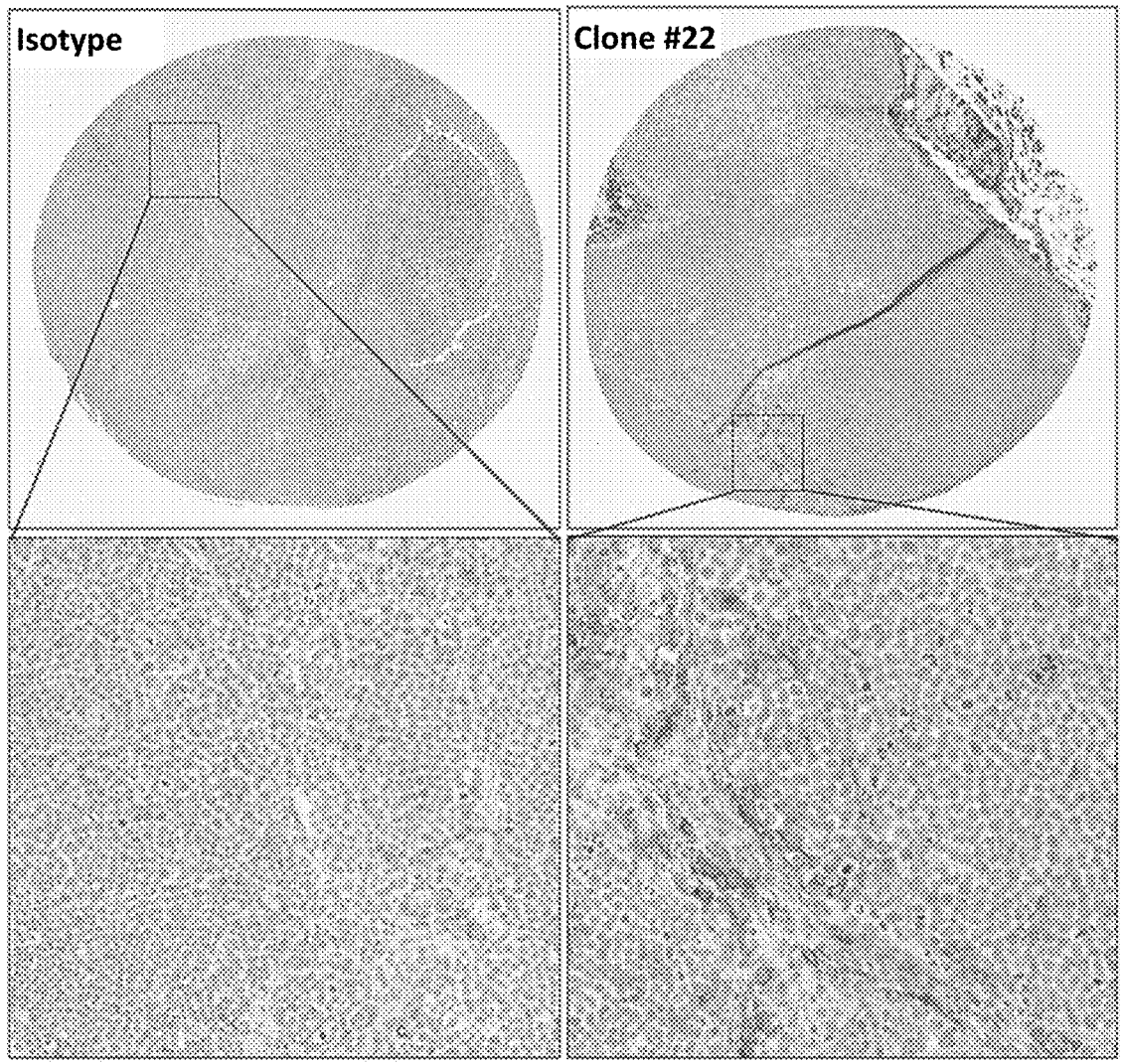
Figure 8D:
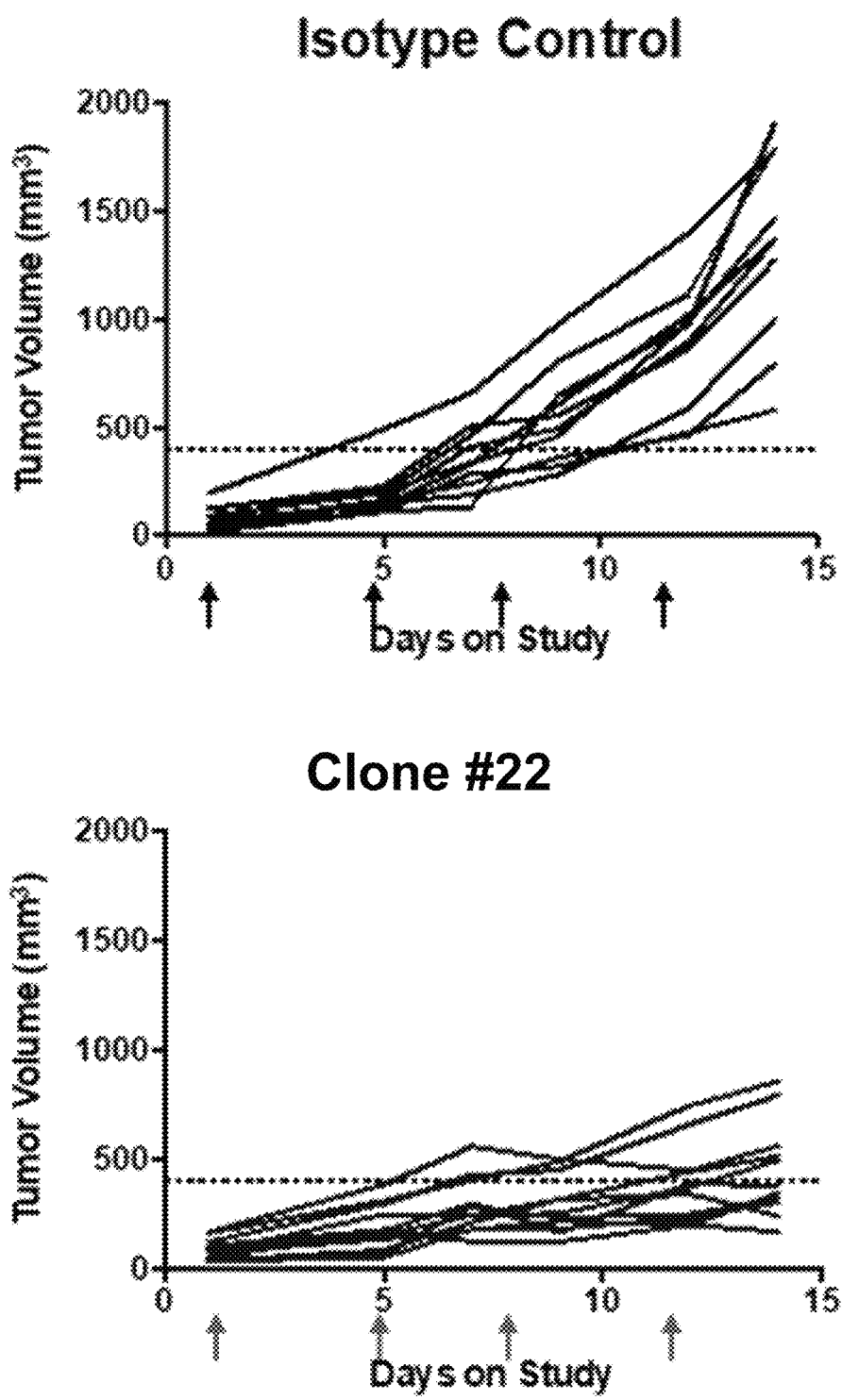

Example 7: Anti-CD39 Antibody Increases Macrophage Infiltration in Tumors from Treated MOLP-8 Xenograft Mice and Reduces Tumor Volume Five to 7-week-old female SCID mice were injected with 1×10⁷ MOLP-8 tumor cells subcutaneously into the right flank and randomized into 2 treatment groups when tumors reached a mean volume of approximately 100 mm³. The groups (n=10-11 mice/group) were treated IP with either 20 mg/kg control IgG4 antibody with a single point mutation at serine 228 to proline (DNP.41) or 20 mg/kg clone 22 or 60 mg/kg clone 22 twice a week for 2 weeks. Tumor samples from 5-7 animals were collected at end of study on Day 14 and were dissociated into single tumor cell suspensions using collagenase and mechanical disaggregation or fixed with formalin. The dissociated tumor cells were stained with a cocktail of mouse antibodies (anti-CD45-BV421, anti-CD11b-BV711 and anti-F4/80-AF488) for 30 min at 4° C. and analyzed by flow cytometry. The percentage of CD45+ cells that were both CD11 b and F4/80 double positive were gated as macrophages. Data shown in FIG. 8A. are the total percentage of macrophages in the isolated CD45+ cells mean±SEM. Statistics were calculated by 2-tailed unpaired t-test (*p<0.05). The fixed samples were stained for murine F4/80 and the percent positive pixel (mean±SEM) algorithm was used for quantitation as shown in FIG. 8B. Sample images from the different treatment groups are depicted in FIG. 8C. As shown in FIG. 8D, mice treated with 60 mg/kg of clone 22 had reduced tumor volume compared to isotype control.

Figure 9A:
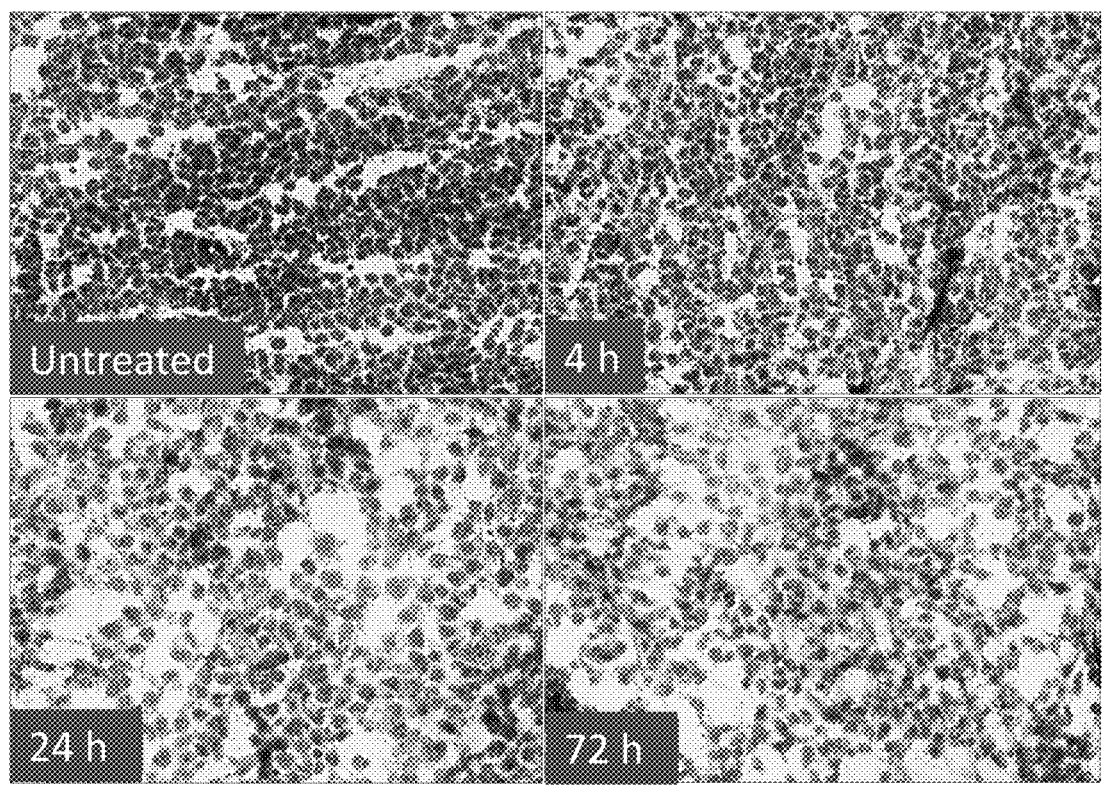
FIGS. 9A and 9B show the ability of clone 22 to inhibit CD39 enzymatic activity in MOLP-8 tumors from treated mice.
Figure 9B:
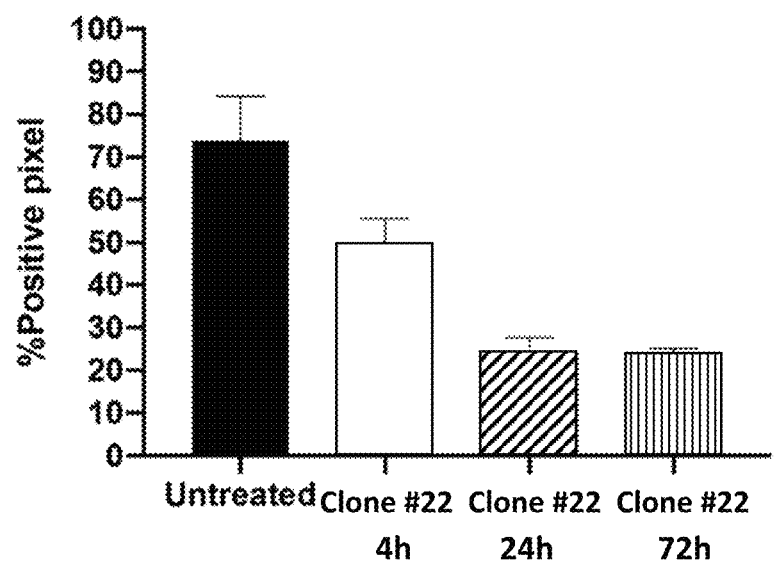

Example 8: Anti-CD39 Antibody Inhibits CD39 Enzymatic Activity in MOLP-8 Tumors from Treated Mice Five to 7-week-old female SCID mice were injected with MOLP-8 tumor cells and divided into 4 groups, 3 time point groups with treatment and 1 control group without treatment, 14 days after tumor inoculation. Mice were treated IP with a single dose of 10 mg/kg clone 22 (n=2 mice/group). Mice were euthanized and tumor samples were collected 4, 24, and 72 hours after treatment with clone 22. Tumor samples were embedded in OCT and a CD39 ATPase assay performed on cryostat tissue sections depicted in FIG. 9A. Strong staining indicates high CD39 ATPase activity. QuPath software (v0.1.2) was used to quantify the in situ CD39 enzymatic assay activity in MOLP-8 tumor samples. ROIs were manually defined to exclude and minimize murine CD39 enzymatic contributions to signal (e.g., murine vasculature) and regions with significant tissue quality artifacts (e.g., tissue folds). The percent positive pixel algorithm was used. Sample images and the percent positive pixel (mean±SEM) obtained from the different treatment groups are depicted in FIG. 9B.

Figure 10:
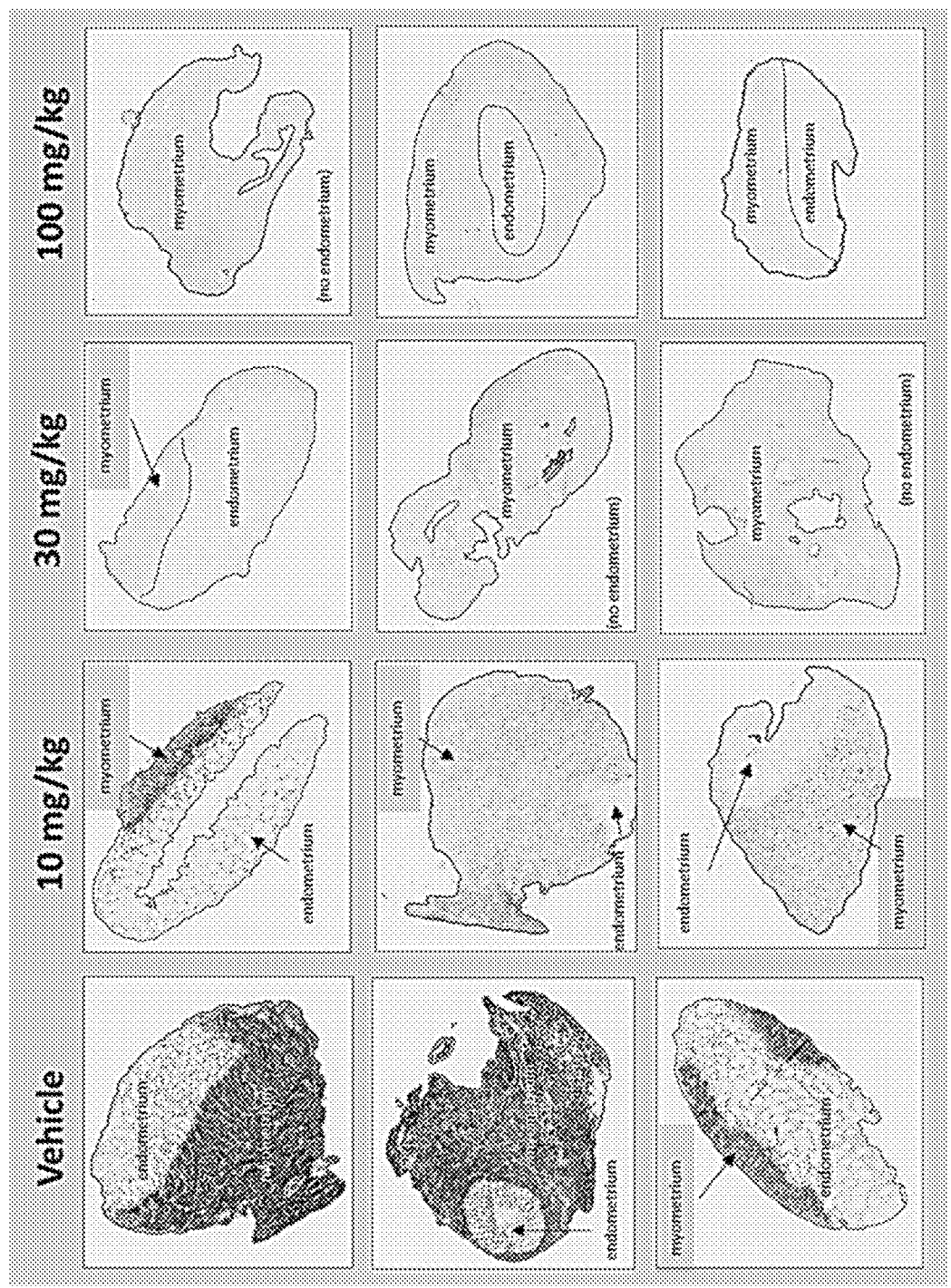
FIG. 10 shows stained slices of uterine tissue from cynomolgus monkeys after CD39 ATPase assay staining from 3 different animals in each dose group: vehicle, 10 mg/kg, 30 mg/kg, and 100 mg/kg clone 22.

Example 9: Anti-CD39 Antibody Inhibits CD39 Enzymatic Activity in Uterine Tissue from Treated Cynomolgus Monkeys Cynomolgus monkeys were treated with vehicle, 10 mg/kg, 30 mg/kg, and 100 mg/kg clone 22 (3 different animals in each dose group). As shown in FIG. 10, slides were scanned of uterine tissue after CD39 ATPase assay staining (ATP staining solution, 15 minutes) from the 3 different animals in each dose group. Images were annotated to distinguish various anatomical compartments within the uterine tissue sections and to highlight the differential degree of CD39 ATPase activity and enzymatic inhibition by clone 22 in the different tissue regions.

Figure 11:
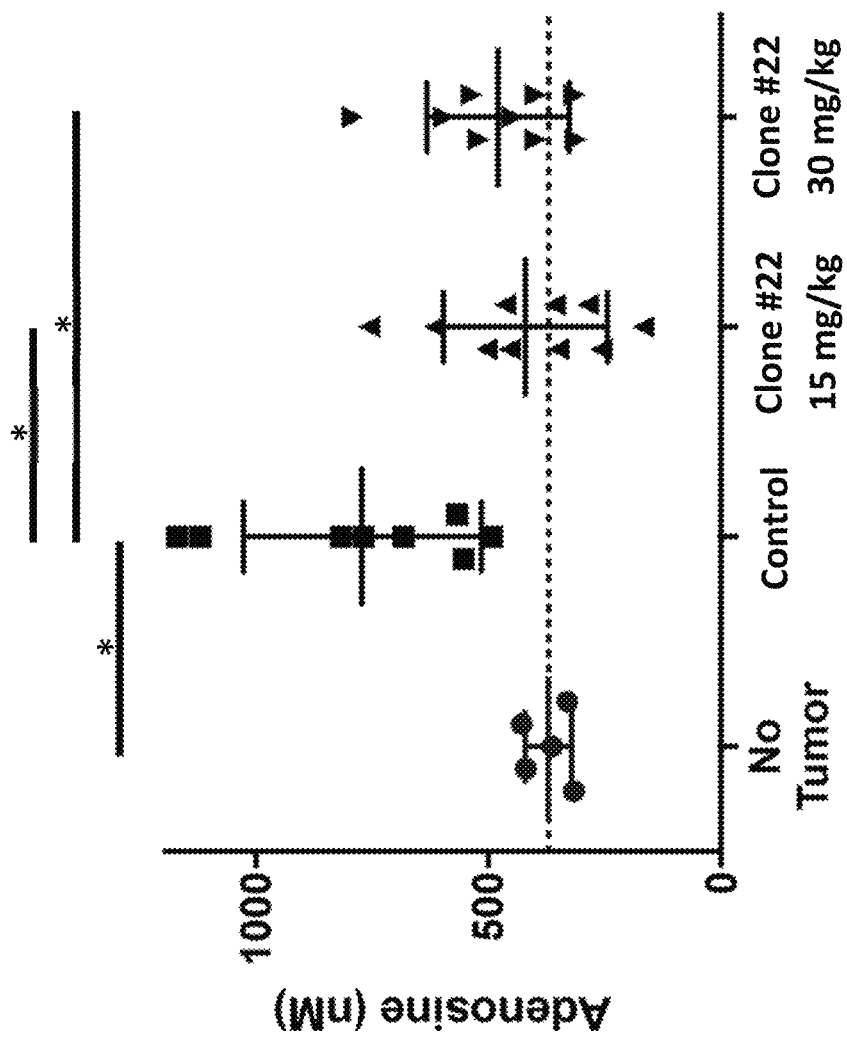
FIG. 11 shows the ability of clone 22 to reduce elevated systemic adenosine levels in H520 xenograft model in mice.

Example 10: Anti-CD39 Antibody Reduces Elevated Systemic Adenosine Levels in the H520 Xenograft Model in Mice Eight to 12-week-old female Ncr nu/nu mice were injected with $1 \times 10^7$ H520 tumor cells subcutaneously into the right flank and randomized into 3 treatment groups when tumors reached a mean volume of approximately 100 mm³. The groups (n=10 mice/group) were treated IP with either 30 mg/kg control IgG4 antibody S228P (DNP.41) or 15 or 30 mg/kg of clone 22 twice a week. An additional group of mice (n=5) with no tumors was added to determine the baseline level of adenosine. Blood samples from evaluable animals were collected on Day 10 of the study (no tumor, n=5; 30 mg/kg control IgG4 antibody S228P (DNP.41), n=8; 15 mg/kg clone 22, n=10; and 30 mg/kg clone 22, n=9), plasma was then isolated and analyzed for adenosine levels using LC-MS/MS. Data are shown as mean±SEM of plasma adenosine levels in FIG. 11. Statistics were calculated by 2-tailed unpaired t-test (*p<0.05).

Example 11: Anti-CD39 Antibody Clone 22 Binds to CD39 in Whole Blood

A whole blood assay was performed to determine the CD39 binding capacity of clone 22 to CD14 and CD19 positive cells. The degree of binding is determined by titration against a saturating dose of clone 22. CD14 and CD19 positive cells were chosen due to their high innate expression of CD39. 200 µL whole blood (WB; Research Blood Components) was aliquoted into v-bottom polypropylene plates. An additional 100 µL was added to the first well of the serial dilution for a total of 300 µL of WB of clone 22. Clone 22 was spiked into 300 µL of WB of the first well to achieve a final concentration of 200 µg/ml. A 1:3 serial dilution of clone 22 in WB was carried across the plate as indicated by transferring 100 µL of blood from well to well serially across plate. The clone 22 serial titration was allowed to incubate at room temperature for 60 minutes, after which a spike of 200 µg/ml clone 22 was added to all the wells of a sample to be used as the "max occupancy" control. This is also sometimes referred to as the 'spike' wells. The entire plate was further incubated at room temperature for an additional 60 minutes to allow the spike wells to incubate. All wells then received 200 µL of ACK lysis buffer (Life Technologies catalog number A10492-01) with mixing. The plate was incubated at room temperature for 5 minutes, spun at 2000 rpm for 5 minutes, and then red blood cell fraction lysed and flicked out of the plate. A fresh 200 µL of ACK lysis buffer was added to all the wells with mixing, and immediately spun at 2000 rpm for 5 minutes. 200 µL of PBS was added to the wells with mixing as a wash step, and immediately spun at 1500 rpm for 5 minutes. 100 µL of PBS were taken to resuspend all samples and transfer them to a 96 well polystyrene u bottom plate. 100 µL of Human TruStain FcX™ (BioLegend catalog number 422302) was added to all wells at 1:50 dilution. The plate was incubated at 4° C. for 15 minutes. A solution of FITC anti-human CD14 (BioLegend catalog number 367166), Brilliant Violet 421™ anti-human CD19 (BioLegend catalog number 302234) and Mouse Anti-Human IgG4-pFc'-PE (Southern Biotech catalog number 9190-09) was prepared in PBS. Anti-CD14 and anti-CD19 were diluted 1:100. Anti-human IgG4 was diluted 1:250. One hundred microliters of anti-CD14, anti-CD19 and anti-IgG4 solution was added to all wells. Extra wells were prepared for individual flow staining of anti-CD14, anti-CD19 and anti-IgG4 in a similar manner. Flow antibodies were incubated at 4° C. for 30 minutes. The plate was immediately spun at 1500 rpm for 5 minutes. 125 µL of FACS buffer was added to all wells. Cells were analyzed on the Fortessa X20 flow cytometer system. % Receptor Occupancy (RO) values were calculated as [% RO=sample geo-MFI/spike geo-MFI].

Figure 12A:
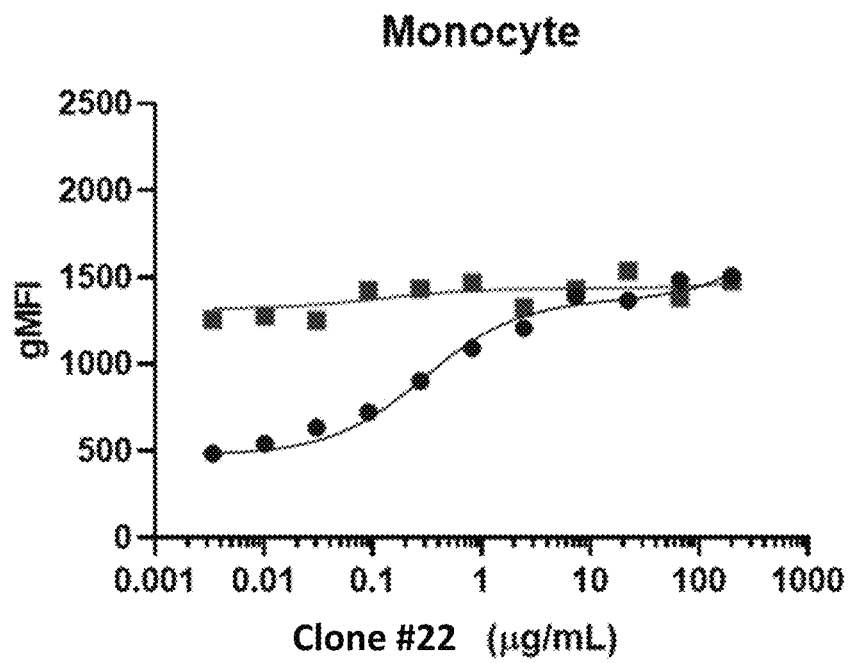
FIGS. 12A, 12B, 12C, 12D, and 12E show clone 22 binding to monocytes (FIG. 12A) and B cells (FIG. 12B) in a dose dependent manner. Percent (%) Target Occupancy (TO) was calculated by comparing dose titration of clone 22 to a saturating "spike" of clone 22 as the max occupancy control for monocytes (FIG. 12C) and B cells (FIG. 12D). Whole blood pre-treated with clone 22 was RBC lysed and the percent (%) inhibition of ATP hydrolysis was calculated (FIG. 12E).
Figure 12B:
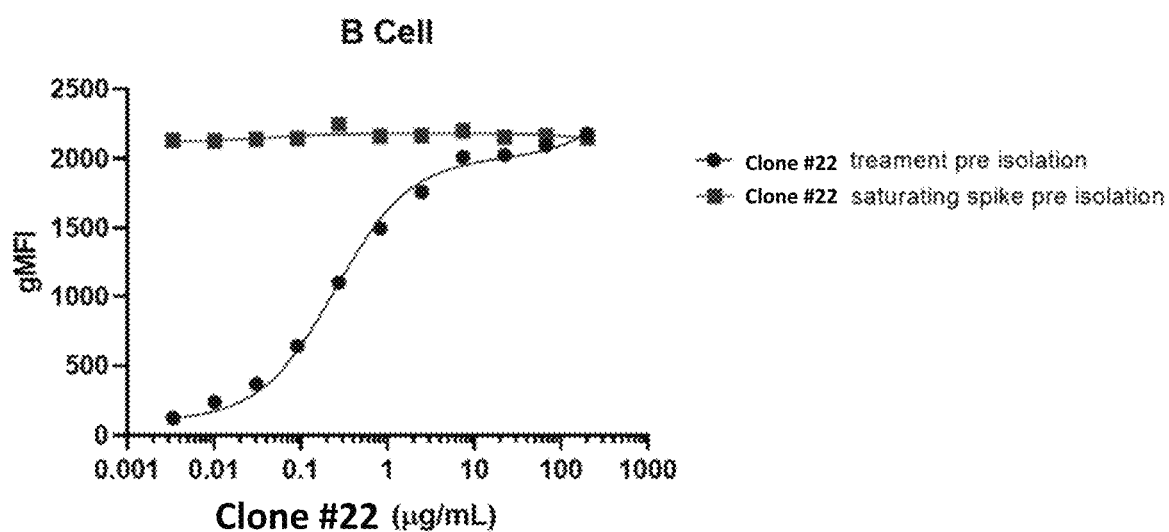
Figure 12C:
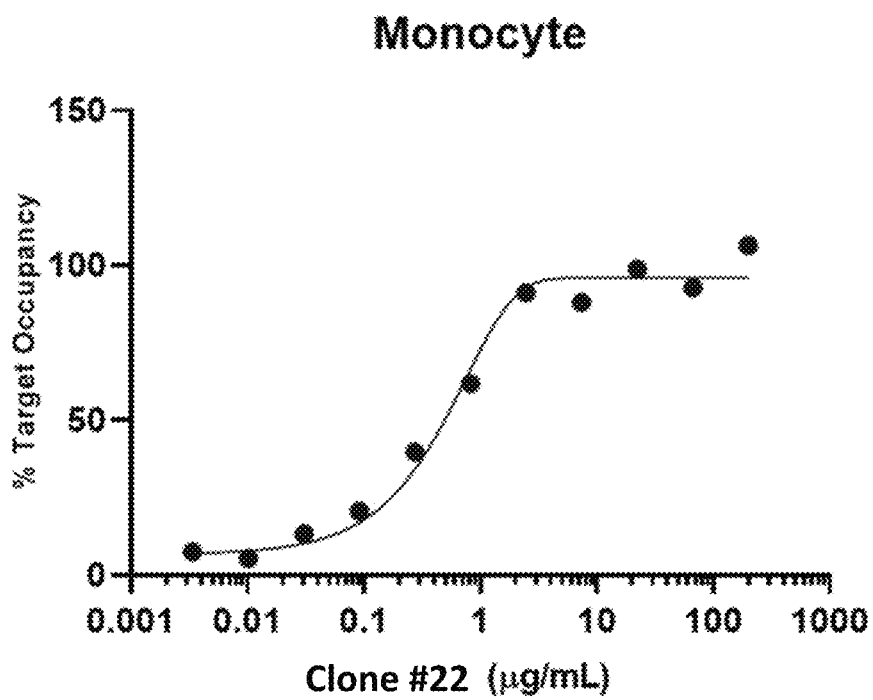
Figure 12D:
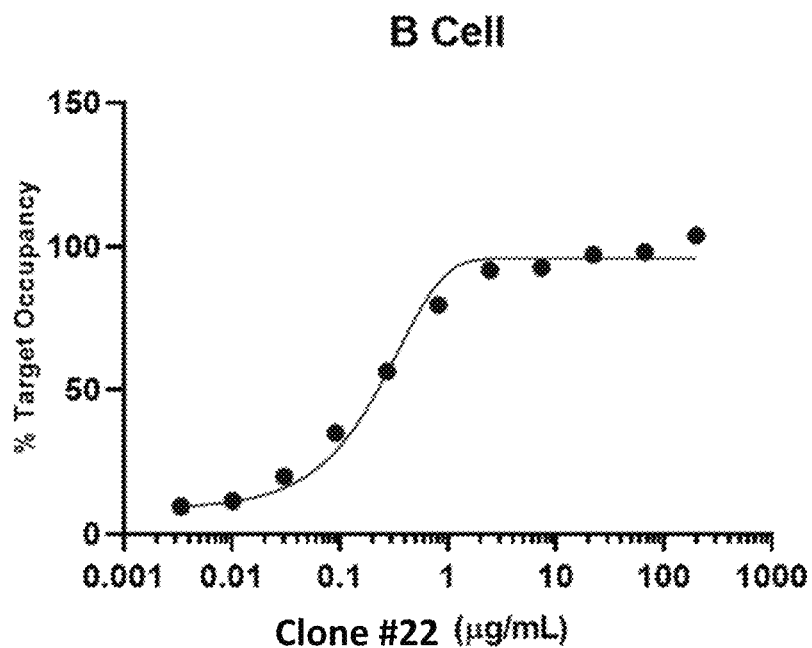

FIGS. 12A-D show that clone 22 binds to monocytes (FIG. 12A) and B cells (FIG. 12B) in whole blood in a dose dependent manner with reasonable signal window. Percent target occupancy (TO) was easily calculated from comparing dose titration of clone 22 to a saturating "spike" of clone 22 as the max occupancy control in monocytes (FIG. 12C) and B cells (FIG. 12D).

Figure 12E:
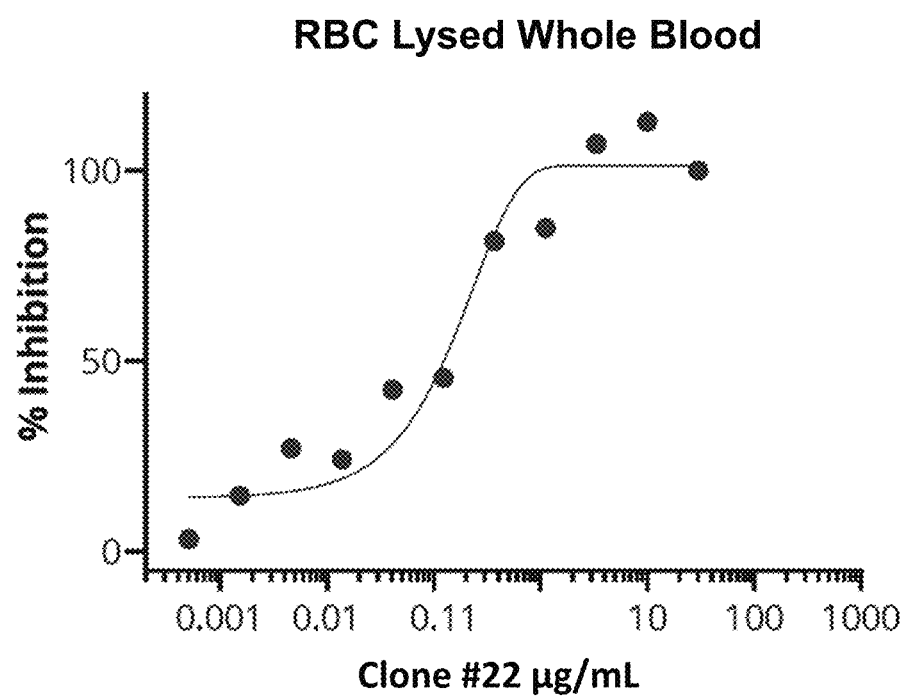

Separately, whole blood cells were pre-treated with clone 22 for 1 hour. Whole blood was RBC lysed and then 25 µM ATP was added to observe ATP hydrolysis. Remaining ATP was quantified using CellTiterGlo™. Low inhibition control (0%) was set at no ATP. High inhibition control (100%) was set at a saturating amount of clone 22. The percent (%) inhibition was calculated as the ratio of sample versus high inhibition control as depicted in FIG. 12E.

Figure 14:
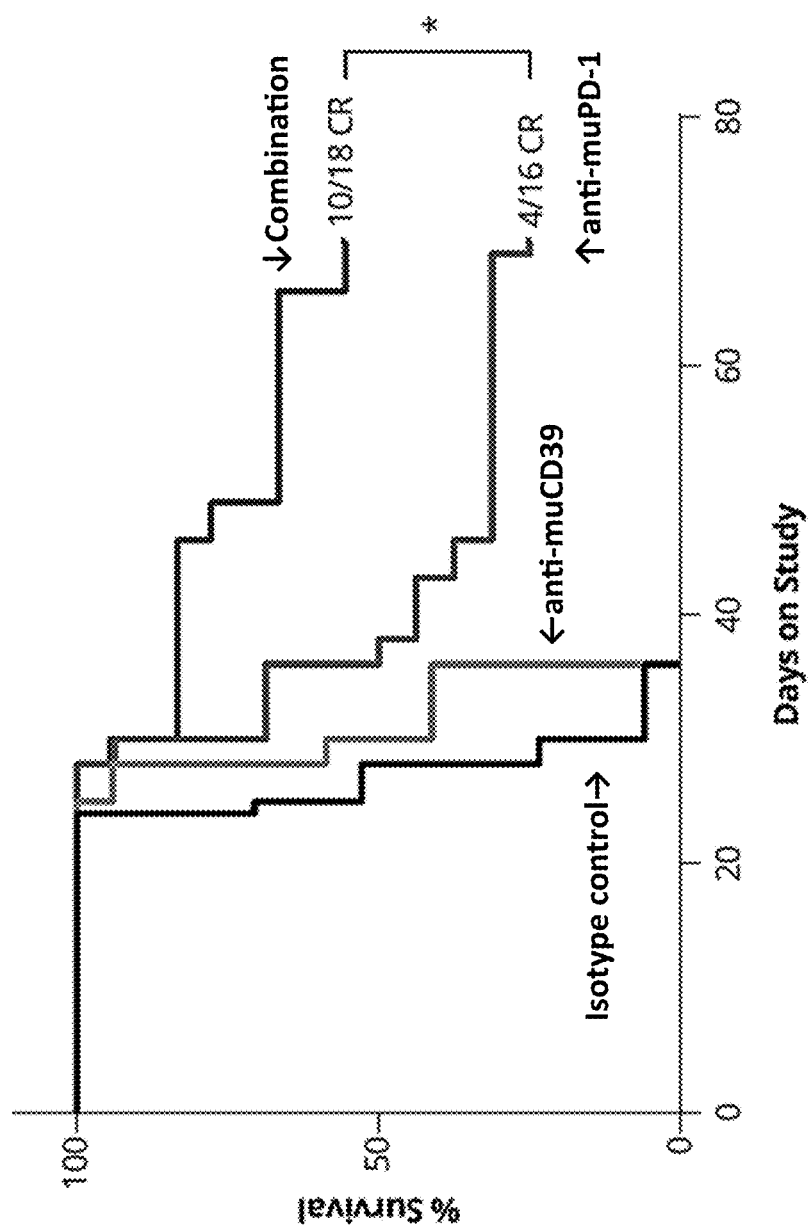
FIG. 14 shows cooperative activity of a murine anti-CD39 antibody in combination with a murine anti-PD-1 antibody in the CT26 mouse model.

Example 12: Murine Anti-CD39 Shows Cooperative Activity in Combination with Anti-PD1 in Murine CT26 Model BALB/C mice were injected with CT26 cells subcutaneously. When tumors reached approximately 80 mm$^3$, mice (n=16-18 mice/group) were treated intraperitoneally with isotype control, 20 mg/kg anti-murine CD39, 10 mg/kg anti-murine PD-1, or anti-murine CD39 and anti-murine PD-1 twice per week for three weeks. FIG. 14 shows the survival analysis curves for the treatment groups (*p<0.05).

Example 13: Increased Triple Positive Cells (PD1, TIM3, Lag3) of CD4+ CD39+ Cells Treated with ATP and Clone 22

Figure 15:
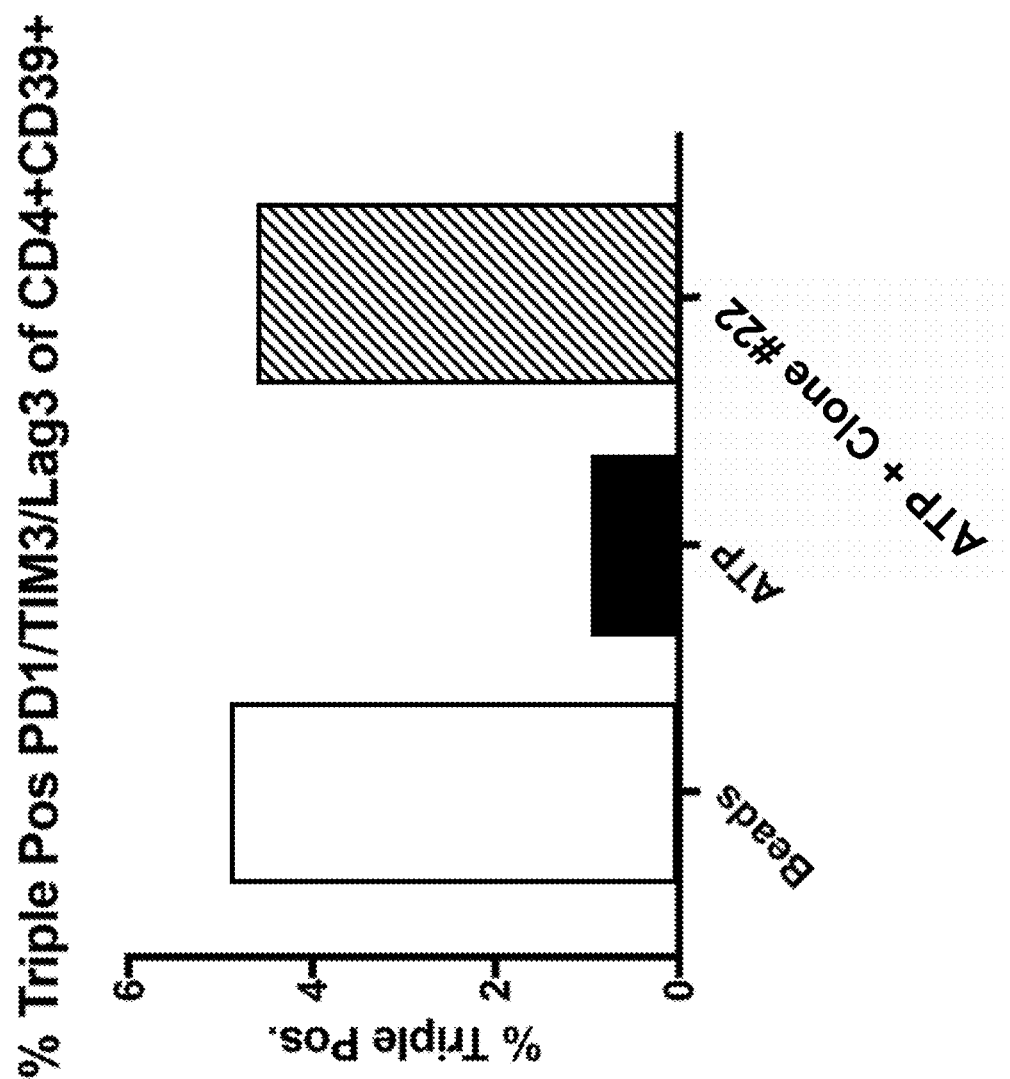
FIG. 15 shows increased percentages of triple positive cells (PD1, TIM3, Lag3) of CD4+ CD39+ cells from PMBCs treated with ATP and clone 22.

Single donor PBMCs at 100,000 cells per well were co-incubated with 100,000 dynabeads per well. Treatments of 500 µM ATP, 500 µM ATP+10 µg/mL clone 22, or no ATP were added at the time of beads. Cells were allowed to incubate for 5 days at 37° C. in a 5% CO$_2$ incubator. Cells were analyzed by flow cytometry gating with the following cellular markers: CD4-BV421, CD8-BV711, CD39-FITC, PD1-PE, TIM3-APC, and Lag3-PE/Cy7. Analysis was quantified as the percent (%) of cells positive for all three markers (PD1, TIM3, and Lag3) in the CD4+ CD39+ gate. Results are shown in FIG. 15.

Example 14: Combination Effect of Anti-CD39 Antibody and Paclitaxel in a H520 Xenograft Model of Human Lung Cancer To determine the anti-tumor effect(s) of combining CD39 with another standard of care chemotherapeutic agent in a solid tumor model, the anti-tumor activity of an anti-CD39 antibody in combination with paclitaxel was evaluated in a subcutaneous xenograft H520, human lung cancer model in athymic nude (NCr nu/nu) mice. Briefly, 8-12-week-old NCr nu/nu mice (Charles River Labs) were inoculated by subcutaneous injection into right flank with 1×10$^7$ H520 tumor cells in 0.1 mL of PBS mixed with Matrigel (1:1) and randomized into 4 treatment groups when tumors reached a mean volume of approximately 60-90 mm$^3$. The groups (n=10-15 mice each) were treated intraperitoneally (i.p) with isotype control (DNP.41), clone 22 alone (600 µg or 30 mg/kg) twice a week for 4 weeks or in combination with paclitaxel. Paclitaxel was administered intravenously (iv) at dose of 10 mg/kg every other day (qod) for 5 doses and 20 mg/kg qod for 4 doses starting at Day 19. All antibodies tested were formulated in PBS (Gibco). Paclitaxel stock solution was prepared in 5% ethanol: 5% cremphor EL in 5% dextrose. Anti-tumor activity was determined, in part, by measuring tumor size (length and width) using a Vernier caliper and tumor volume was calculated using the following formula: (L*W*W)/2. Body weight (data not shown) and tumor volumes were determined thrice weekly until day 68. Animals were terminated when they reached a tumor volume of 1800 mm$^3$. Kaplan Meier survival curves were plotted to measure overall survival. For survival analysis, a log-rank test was performed to test statistical significance for each group compared to control and to the single agent alone treatment arms. (p<0.005).

Figure 16:
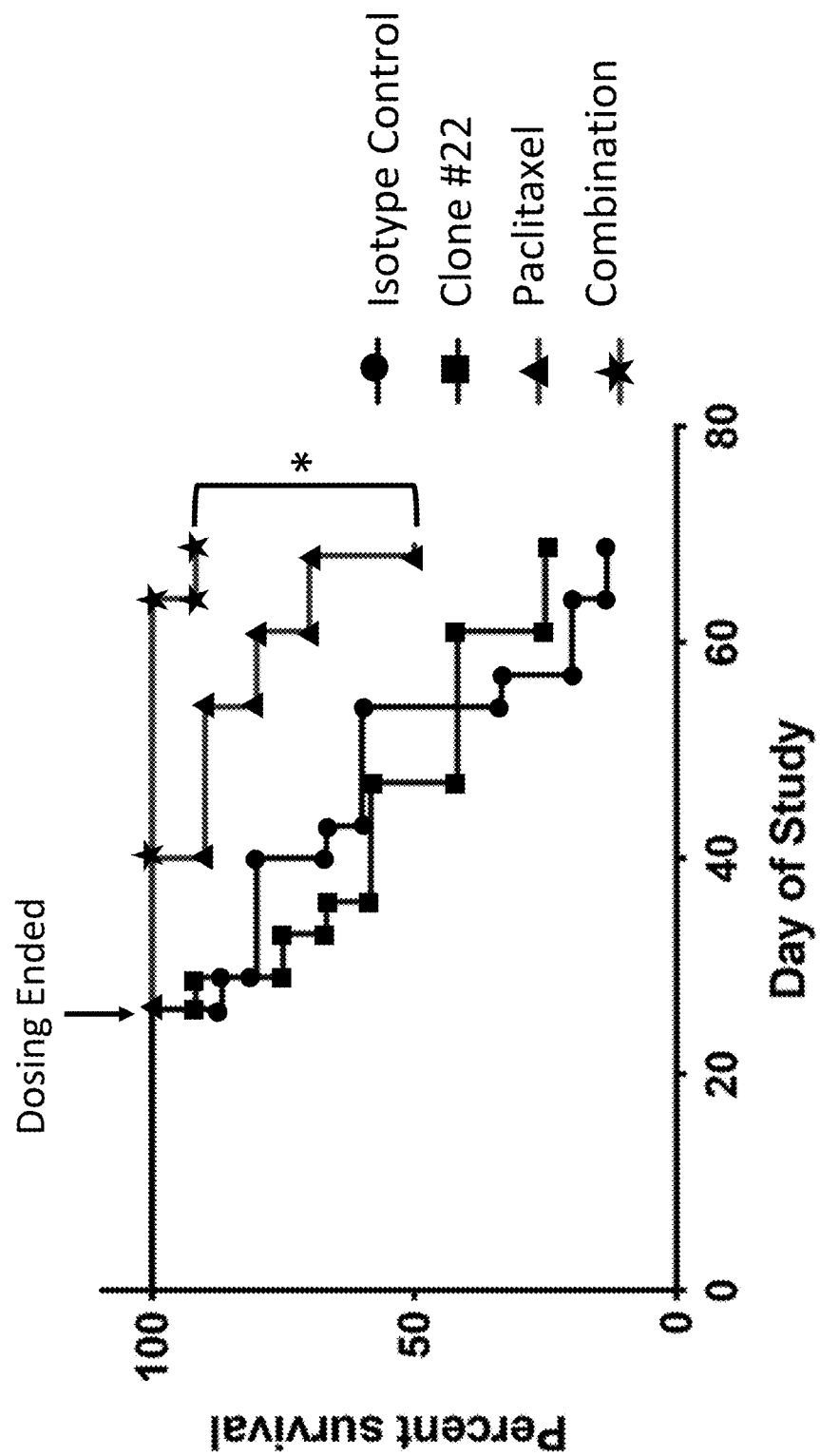
FIG. 16 shows a combination effect of clone 22 and Paclitaxel in a H520 xenograft model of human lung cancer.

Survival curves of treated mice are shown in FIG. 16. These data indicate that treatment with an anti-CD39 antibody clone 22 in combination with paclitaxel result in a significant combination anti-tumor effect, reducing tumor volume to a greater extent when compared to treatment with either an anti-CD39 antibody or paclitaxel alone and significantly improving survival. Treatment with all test antibodies (anti-CD39 and paclitaxel) in combination, demonstrated statistically significant anti-tumor efficacy compared to isotype control (p<0.05).

Figure 17A:
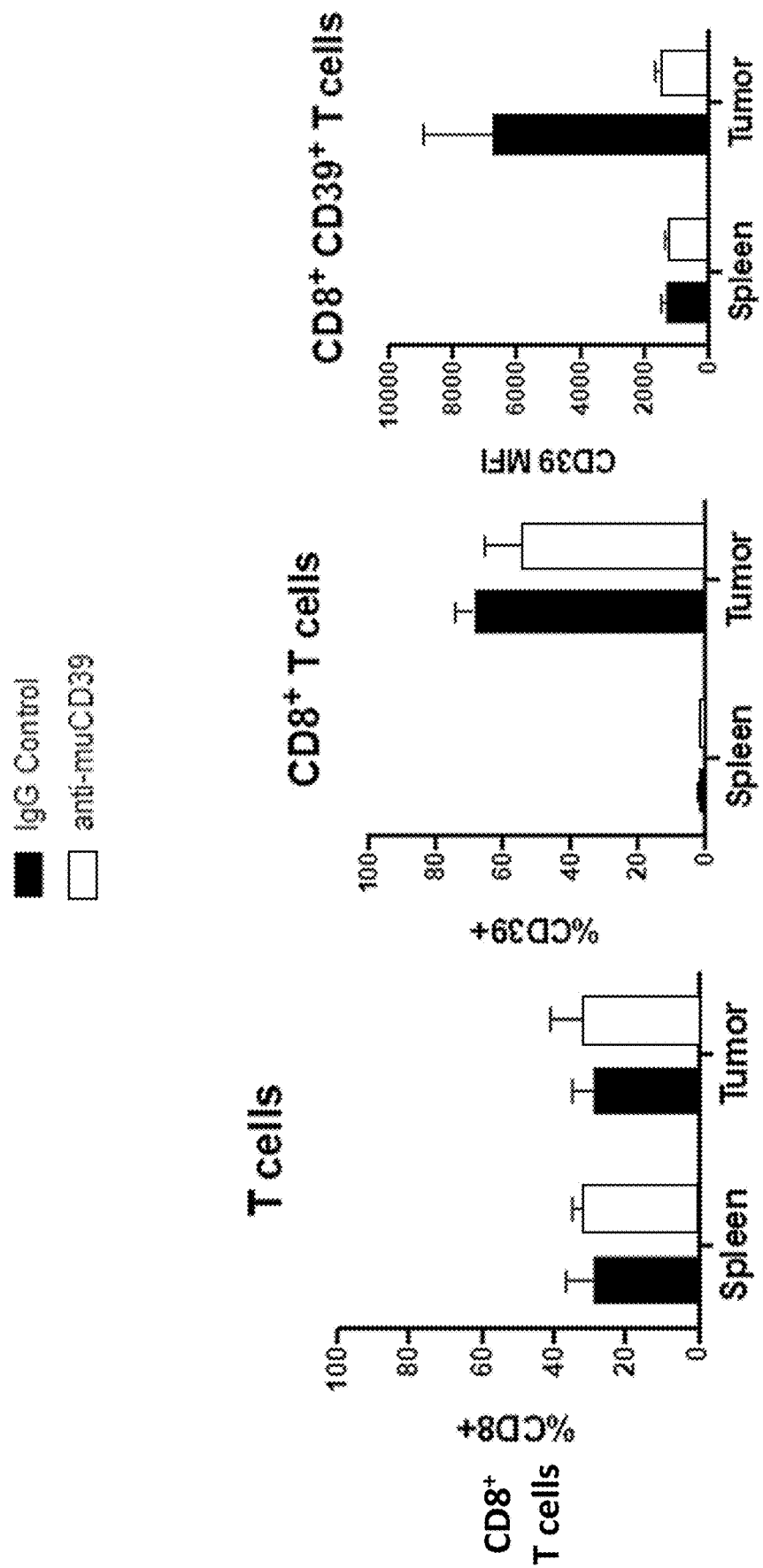
FIGS. 17A, 17B, 17C and 17D shows the effect of a murine anti-CD39 antibody on tumor infiltrating lymphocytes: CD8+ T cells (FIG. 17A), CD4+ T cells (FIG. 17B), and T regulatory cells (FIG. 17C) in the CT26 mouse model, and the effect on tumor volume (FIG. 17D).
Figure 17B:
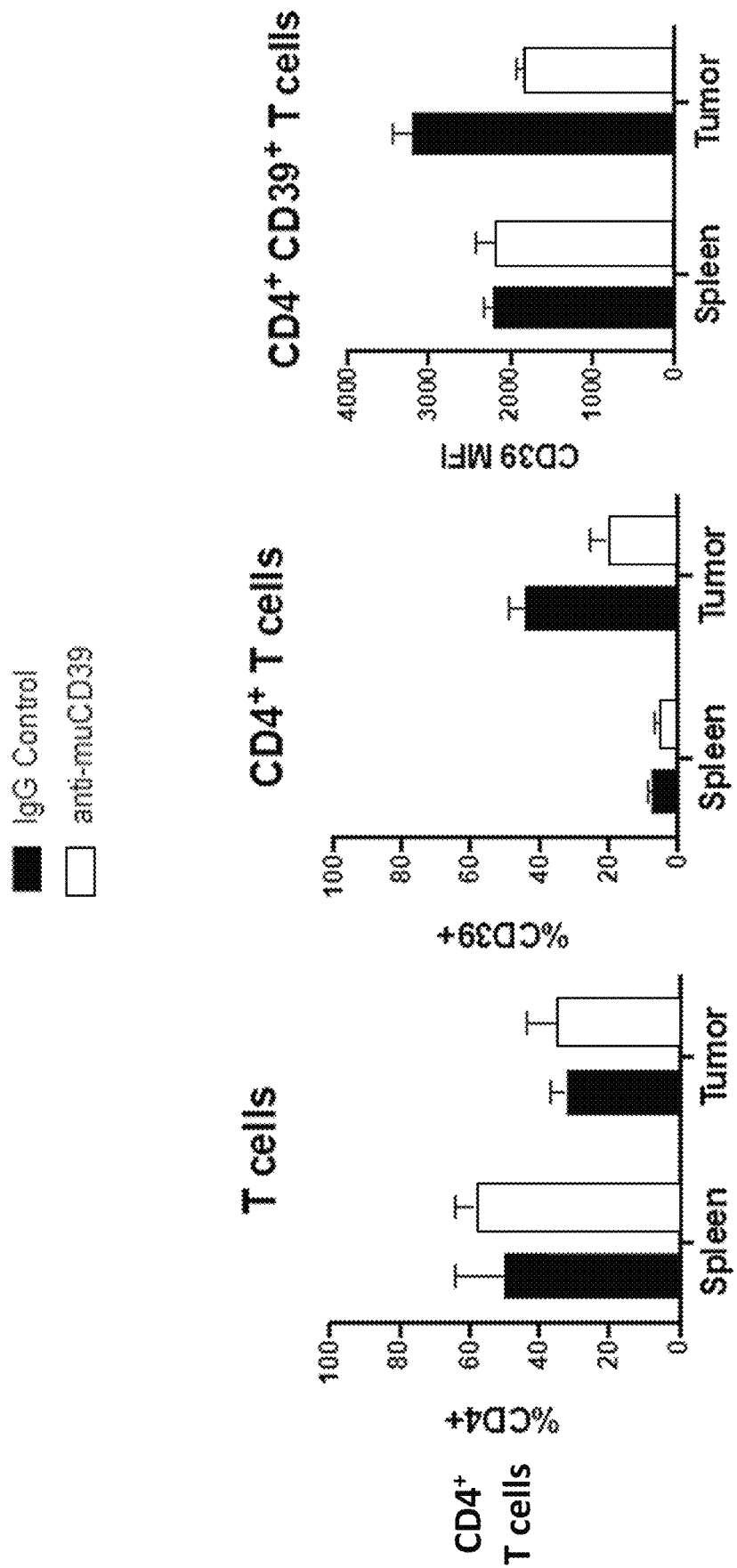
Figure 17C:
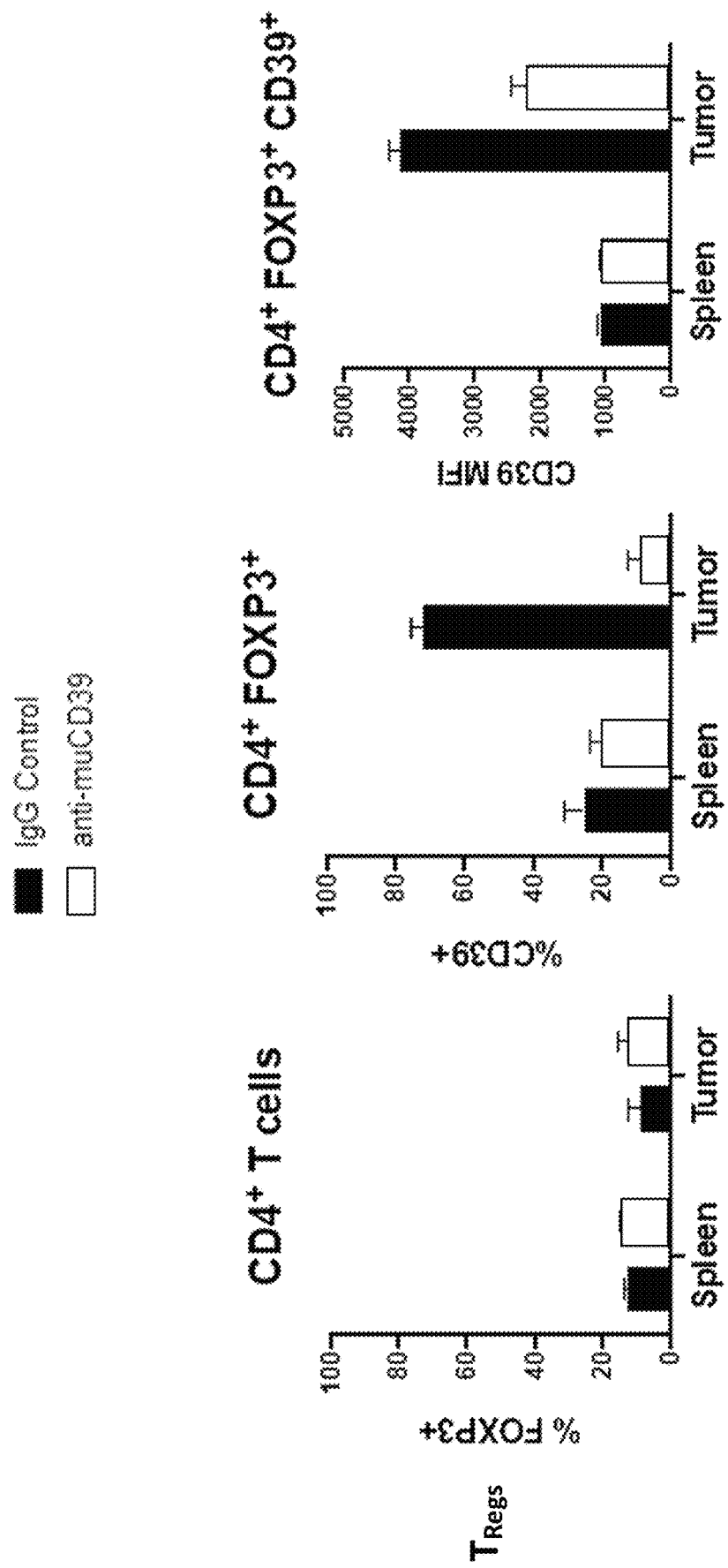
Figure 17D:
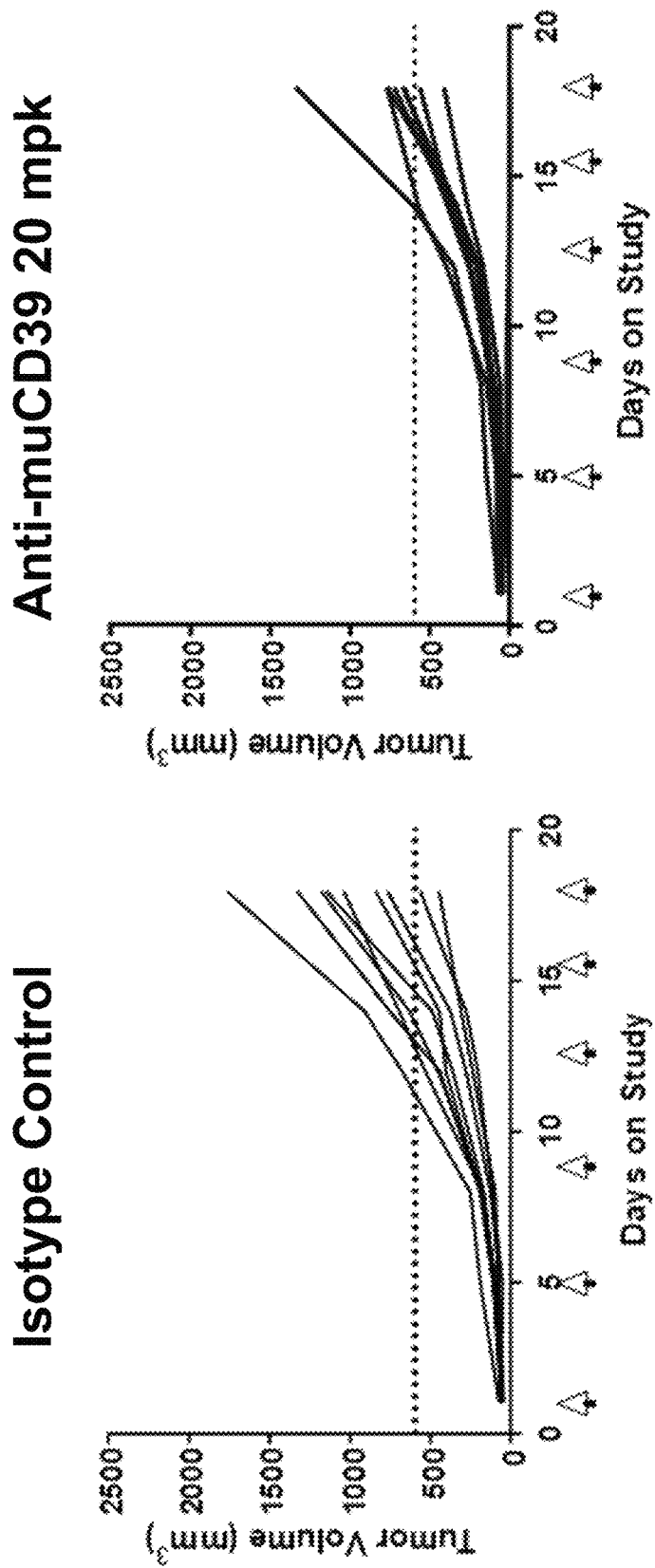

Example 15: Effect of Murine Anti-CD39 on Tumor Infiltrating Lymphocytes in Murine CT26 Model BALB/C mice bearing CT26 colorectal tumors were dosed BIW with 20 mg/kg murine anti-CD39 antibody three times (Day 11) before tumors were removed and dissociated for flow analysis. CD45+ cells were stained with antibodies targeting the following markers to identify Tumor Infiltrating Lymphocyte (TIL) populations: CD3, CD4, CD8, CD25, CD27, CD39, CD45, F4/80, NKp46, FOXP3, and CD279. Flow analysis was performed using FlowjoV10. The effects are shown for CD8+ T cells (FIG. 17A), CD4+ T cells (FIG. 17B), and Tregs (FIG. 17C). The effect on tumor volume as compared to isotype control is shown in FIG. 17D.

Figure 18:
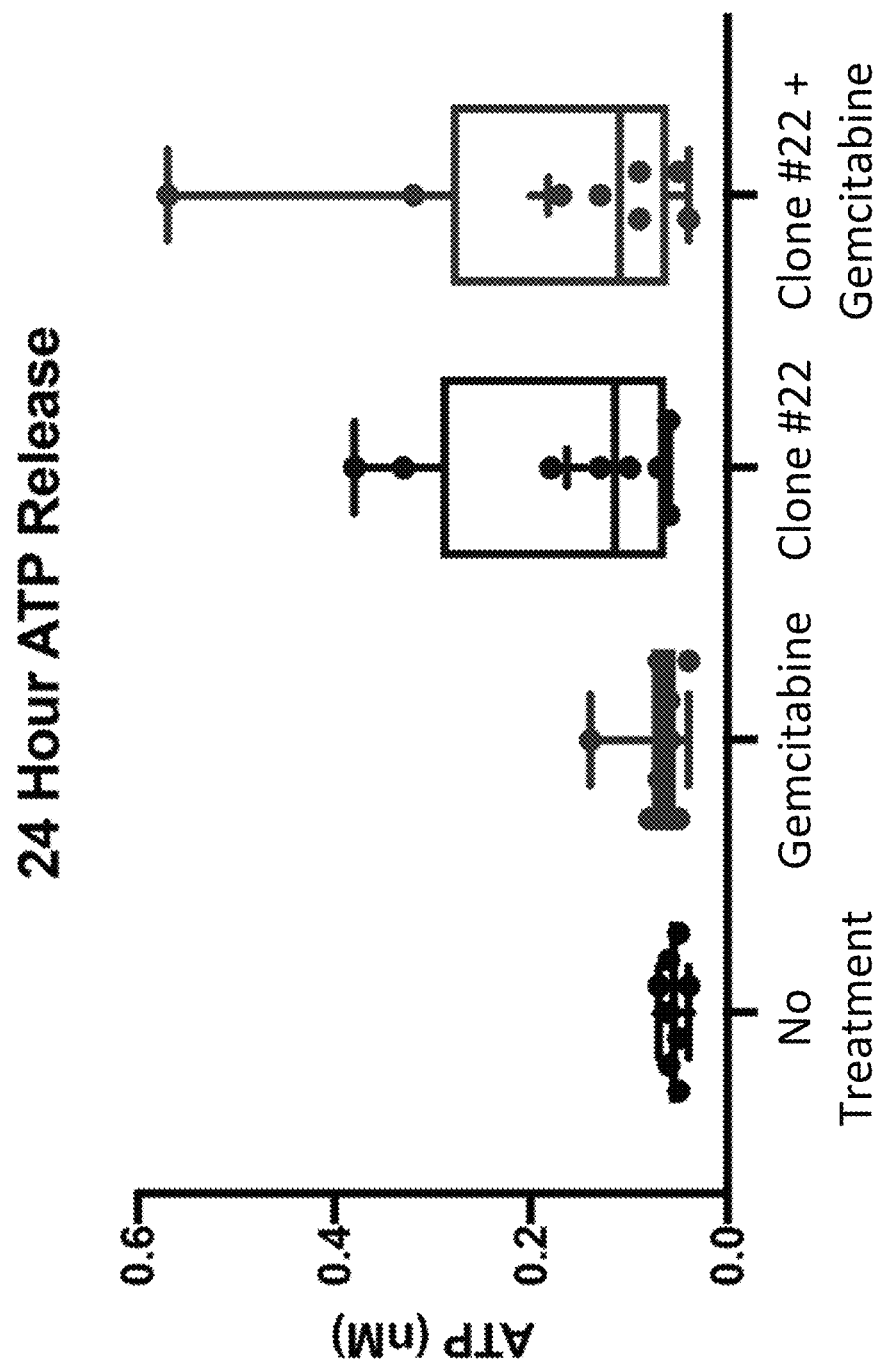
FIG. 18 shows the effect of clone 22 alone and in combination with gemcitabine in a human tumor biopsy model of pancreatic ductal adenocarcinoma.

Example 16: Combination Effect of Anti-CD39 Antibody and Gemcitabine in a Human PDAC Tumor Biopsy Model Tumor biopsies were taken from eight pancreatic ductal adenocarcinoma (PDAC) patients and divided into four different samples each. The four samples from each tumor biopsy were treated using four different conditions: 1) vehicle+isotype control, 2) gemcitabine+isotype control, 3) vehicle+clone 22, and 4) gemcitabine+clone 22. After 24 h the supernatants were tested for ATP levels. ATP levels increased in the groups exposed to clone 22 when administered as a monotherapy or in combination with gemcitabine as shown in FIG. 18.

Example 17: Synergistic Effect of Anti-CD39 and Anti-CD47 Antibody Blockade in a MOLP-8 Murine Model of Human Multiple Myeloma To determine the anti-tumor effect(s) of blocking both CD39 and CD47, the anti-tumor activity of an anti-CD39 antibody, clone 22, in combination with an anti-CD47 antibody (SEQ ID NO: 40004 (heavy chain comprising a wild-type human IgG4 constant); SEQ ID NO: 40005 (light chain)) was evaluated in a subcutaneous xenograft MOLP-8, human multiple myeloma model in severe combined immunodeficient (SCID) mice. The ability of the combination to enhance survival was also determined. Briefly, 6-8 week-old SCID mice (Charles River Labs) were inoculated by subcutaneous injection into right flank with 1×10$^7$ MOLP-8 tumor cells in 0.1 mL of PBS mixed with Matrigel (1:1) and randomized into 4 treatment groups when tumors reached a mean volume of approximately 100 mm$^3$. The groups (n=10 mice each) were treated intraperitoneally (i.p) with isotype control (monoclonal human IgG4 (IgG4-A)), clone 22 alone (400 µg or 20 mg/kg) twice a week for 3 weeks, anti-CD47 antibody alone (60 µg or 3 mg/kg) once a week for 3 weeks or both clone 22 and anti-CD47 antibody in combination dosed on the same schedule as monotherapies. All antibodies tested were formulated in PBS (Gibco). Anti-tumor activity was determined, in part, by measuring tumor size (length and width) using a Vernier caliper and tumor volume was calculated using the following formula: (L*W*W)/2. Body weight (data not shown) and tumor volumes were determined twice weekly until day 18. For tumor volume analysis, a one-way Anova analysis was performed to test statistical significance for each group compared to control ($p<0.005$). For survival analysis, mice were euthanized after day 18 either when tumor volume reached 1000 mm$^3$ or when the tumors became necrotic. The survival statistics were analyzed using Kaplan Meier curves and significance was calculated using log rank (Mantel-cox) test ($p<0.005$).

Figure 19B:
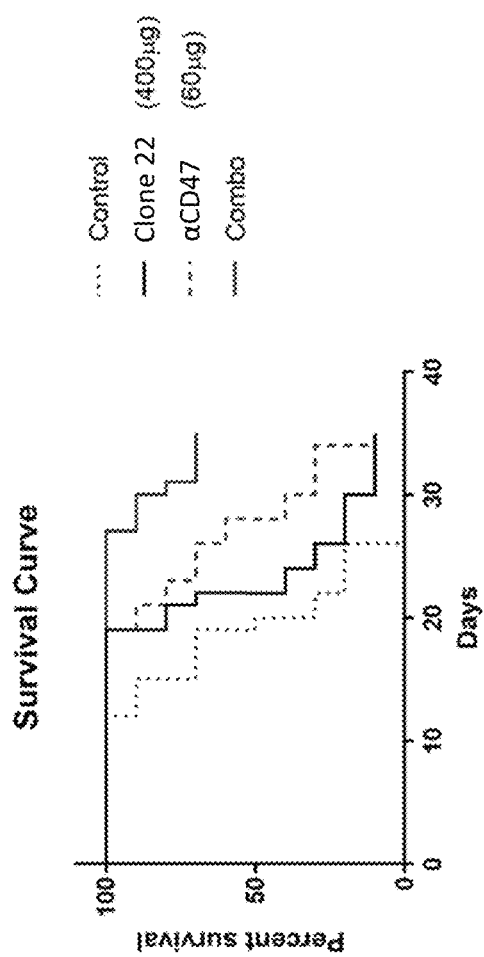
FIGS. 19A and 19B shows the effect of clone 22 alone, or an anti-CD47 antibody alone, or the combination of clone 22 and an anti-CD47 antibody on tumor volume (FIG. 19A) and survival (FIG. 19B) in a MOLP-8 murine model of human multiple myeloma.
Figure 19A:
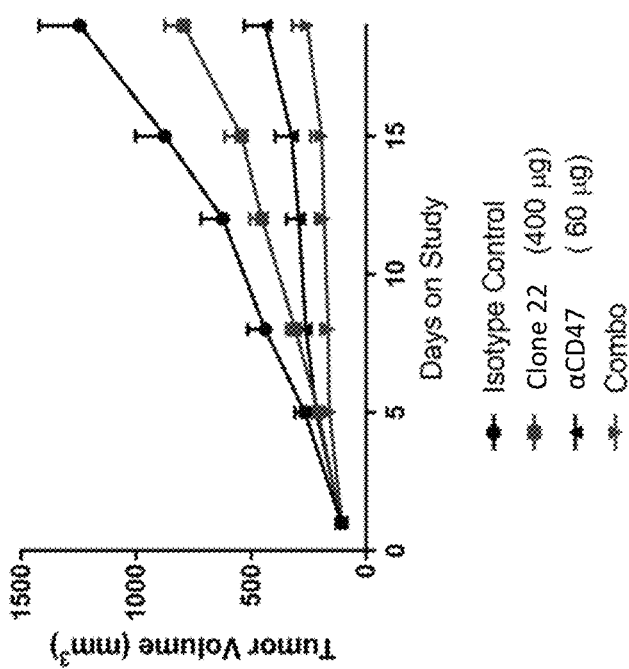

Mean tumor volumes and percent survival of treated mice are shown in FIG. 19A and FIG. 19B, respectively. These data indicate that treatment with an anti-CD39 antibody, clone 22, in combination with an anti-CD47 antibody result in a synergistic anti-tumor effect, reducing tumor volume and increasing mouse survival to a greater extent when compared to treatment with either antibody as a monotherapy. Treatment with all test antibodies, alone or in combination, demonstrated statistically significant anti-tumor efficacy compared to isotype control ($p<0.005$). No adverse effect on body weight was observed in any of the groups (data not shown).

Example 18: Effect of Murine Anti-CD39 and Anti-PD1 on the Tumor Microenvironment in the Murine CT26 Tumor Model The effect of anti-CD39 alone and in combination with anti-PD-1 treatment on immune cells in the tumor microenvironment (TME) was evaluated in the CT26 murine tumor model.

BALB/C mice bearing CT26 tumors were treated with three doses of isotype control antibody (400 µg), anti-murine CD39 antibody (400 µg), anti-murine PD-1 antibody (200 µg), or a combination of anti-murine CD39 (400 µg), and anti-murine PD-1 (200 µg) antibodies prior to tumor harvest on day 9; n=10 per group. The tumors were extracted from each mouse and enzymatical dissociated with a combination of collagenase and DNAse treatments using a Miltenyi Biotec gentle MACS dissociator (see worldwide web at miltenyibiotec.com/US-en/products/gentlemacs-dissociator.html#gref). Debris and dead cells were removed subsequent to centrifugation. Cells were resuspended in Dulbecco's Modified Eagle Medium (DMEM). Immune cells from the tumors were enriched by using CD45+ magnetic beads and captured on magnetic columns.

Single-cell RNA sequencing (scRNA seq) experiments were performed to evaluate immune cells isolated from the TME of treated mice using a standard 10× genomics 3' mRNA protocol. Briefly, gel bead emulsions (GEMs) were created on a 10× microfluidic chip where cell samples are were with oil and PCR/barcode reagents in a controlled manner, resulting in droplets containing single cells, oligonucleotide barcodes and the chemistry for later PCR steps. Cells in these droplets lyse and their RNA was tagged with barcodes and poly A capture oligonucleotides (10× Genomics Chromium Single Cell 3' Reagent Kit, CG000183 Rev C). Samples were sequenced using an Illumina NextSeq500 instrument.

Figure 20:
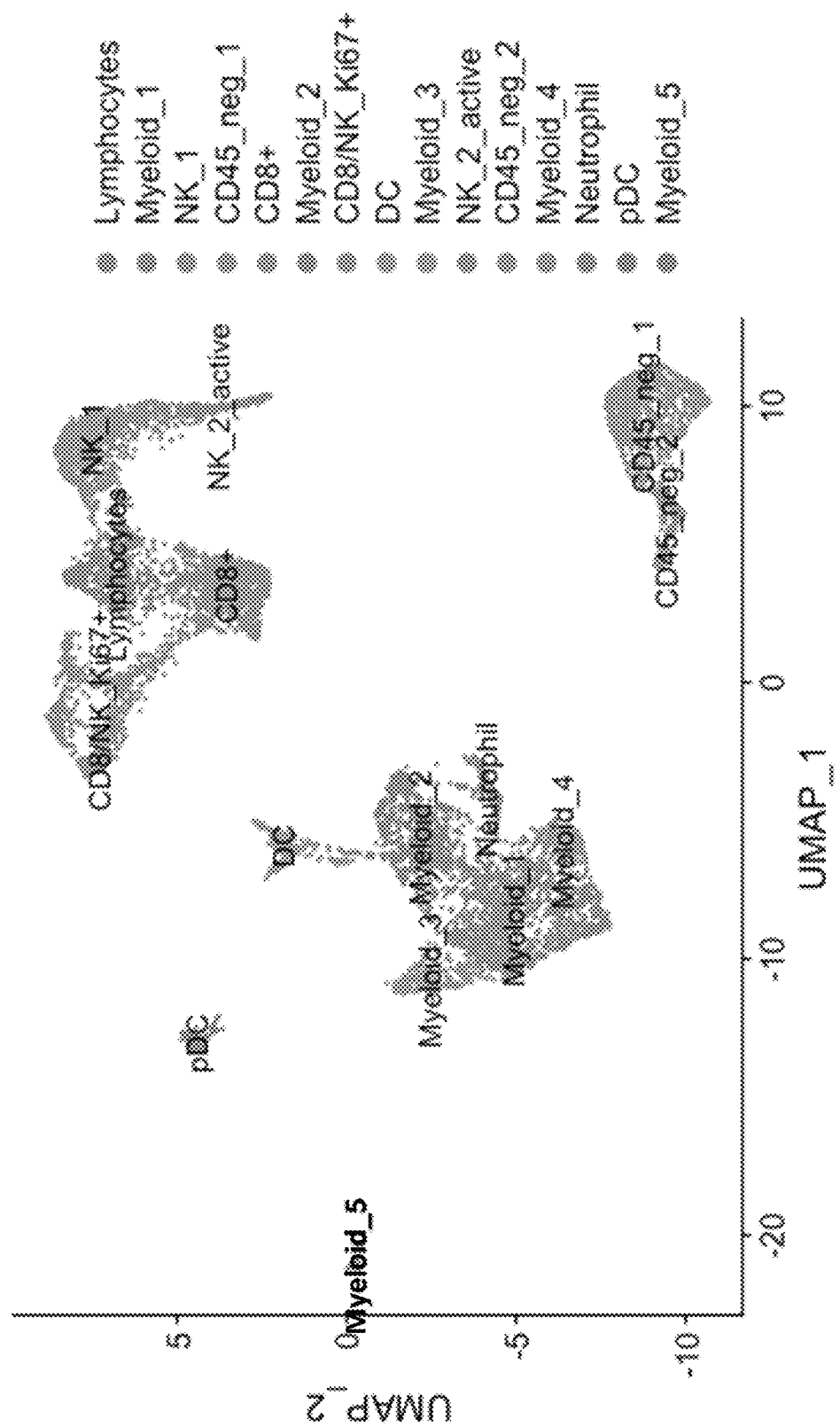
FIG. 20 shows results from single-cell RNA sequencing (scRNAseq) of immune cells in the TME of CT26 mice from a composite analysis of mice treated with isotype control antibody, anti-murine CD39 antibody, anti-murine PD-1 antibody, and a combination of both anti-murine CD39 antibody and anti-murine PD-1 antibody. Cell types are clustered based on differential expression of immune markers. The X and Y axis show Uniform Manifold Approximation Projections (UMAP), a dimensionality reduction algorithm applied to perform the scRNAseq analysis. The X and Y coordinates show the distance between each cell, demonstrating clusters of cells that were mapped to a particular phenotype.

From the scRNAseq results, data from individual cells were assigned to clusters of immune cell types based on differential expression of immune cell markers (FIG. 20). Major cell type clusters were lymphocyte/NK, macrophage/myeloid, and CD45 negative cells. Clustering results of scRNAseq provided adequate separation of cell types in the TME for downstream analysis.

Figure 21C:
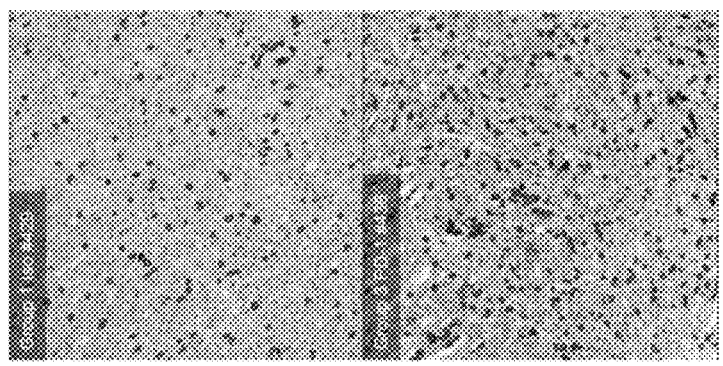
FIGS. 21A-C show increased lymphocyte infiltrate in the TME of CT26 mice treated with anti-murine PD-1 antibody alone or in combination with anti-murine CD39 antibody.
Figure 21B:
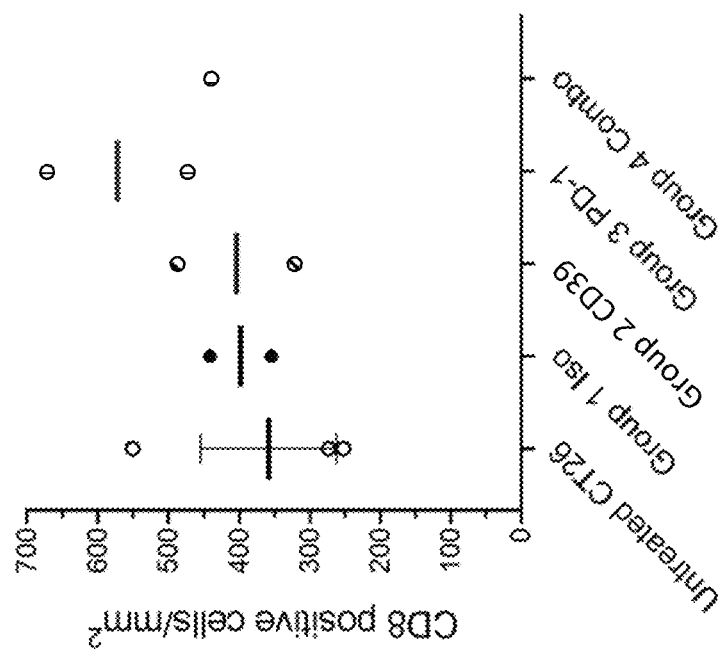
Figure 21A:
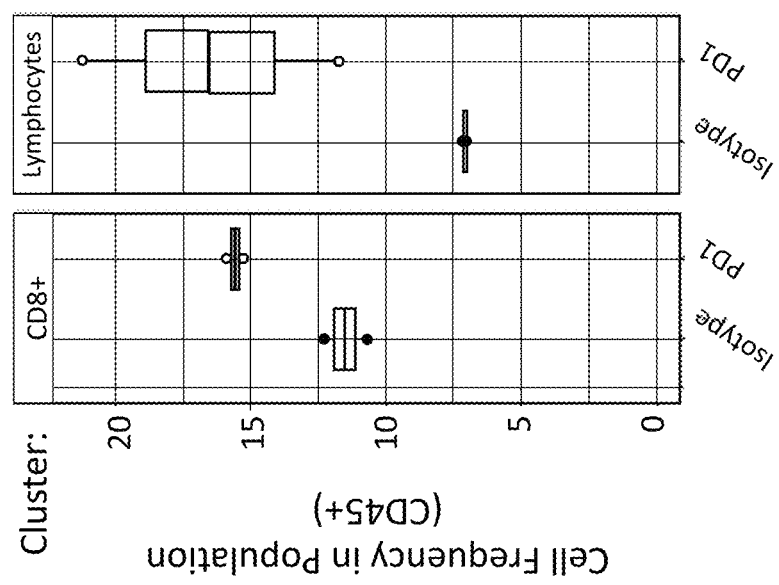

An increase in frequency of CD45+ cells within the CD8+ and lymphocyte cluster of cells from the TME was observed in mice treated with anti-PD1 as compared to mice treated with the isotype control antibody (FIG. 21A), indicating that treatment with anti-PD1 increased lymphocyte infiltrate in the TME. Consistent with these data, tumors from mice treated with anti-PD1 showed an increase in CD8+ T cell density by immunohistochemistry staining (FIG. 21B and FIG. 21C). Tumor samples were processed using standard formalin-fixed paraffin-embedded (FFPE) tissues methods and sectioned at 5 microns. Immunohistochemistry staining was performed with a mouse-specific rat monoclonal anti-CD8 antibody (clone 4SM15, Thermo Fisher Scientific, Waltham, Mass.) at 1:50 dilution using a Leica Bond automated stainer (Leica Biosystems, Buffalo Grove, Ill.). Stained slides were digitally scanned using an Aperio Versa scanner (Leica Biosystems, Buffalo Grove, Ill.). To obtain the density of CD8+ T cells, quantitative image analysis was performed using the multiplex IHC module in the HALO software suite version 3.0.311.228 (Indica Labs, Albuquerque, N. Mex.).

Results from the scRNAseq analysis showed an increase in fold change in myeloid and NK cells in mice treated with anti-CD39 as compared to mice treated with the isotype control antibody (FIG. 22), indicating that treatment with anti-CD39 increased infiltration of innate cells in the TME. It was observed that cell populations expressing the P2X7 receptor, which upon activation can induce the release of ATP, were responsive to treatment.

Treatment with anti-CD39 was also found to upregulate interferon gamma (IFNγ)-response genes in tumor-associated macrophages. Macrophages were identified as a subset of cells from the scRNAseq dataset based on F4/80 antigen expression. Differential expression analysis was performed to identify sets of genes that were more highly expressed in the TME of mice treated with anti-CD39 v. isotype control. The top enriched genes were related to an upregulated IFNγ response (FIG. 23A), demonstrating that an immune response had occurred or was occurring following anti-CD39 treatment. Data from all samples were integrated using Suerat version 3. Cells were then clustered using UMAP dimensionality reduction, identifying approximately 20 distinct cell clusters (FIG. 23B). The plot in FIG. 23 was generated from the whole dataset using the following code:

data<-RunUMAP(data, reduction="pca", dims=1:significant_PC, verbose=FALSE)

UMAP_coloredby_cluster<-DimPlot(data, reduction="umap", label=TRUE)

UMAP_coloredby_cluster

Table 3 below shows the most variable genes in each cell cluster.

TABLE 3

| Gene | Cluster | Log Fold Change | p_value | PCA1 | PCA2 |
| --- | --- | --- | --- | --- | --- |
| Ccl8 | 0 | 2.3168896 | 0.00E+00 | 0.701 | 0.146 |
| Apoe | 0 | 2.2393643 | 0.00E+00 | 0.937 | 0.237 |
| C1qa | 0 | 2.2014202 | 0.00E+00 | 0.932 | 0.164 |
| C1qb | 0 | 2.0741145 | 0.00E+00 | 0.906 | 0.149 |
| C1qc | 0 | 1.9959198 | 0.00E+00 | 0.878 | 0.128 |
| Arg1 | 0 | 1.7524871 | 0.00E+00 | 0.409 | 0.058 |
| Lgmn | 0 | 1.737906 | 0.00E+00 | 0.848 | 0.171 |
| Ms4a7 | 0 | 1.7373085 | 0.00E+00 | 0.663 | 0.092 |
| Lyz2 | 0 | 1.7336814 | 0.00E+00 | 0.986 | 0.341 |
| Ccl7 | 0 | 1.679002 | 0.00E+00 | 0.696 | 0.136 |
| Cd3g | 1 | 1.8866825 | 0.00E+00 | 0.81 | 0.171 |
| Cxcr6 | 1 | 1.7092964 | 0.00E+00 | 0.448 | 0.062 |
| Cd8a | 1 | 1.6728946 | 0.00E+00 | 0.474 | 0.068 |
| Trbc2 | 1 | 1.657806 | 0.00E+00 | 0.775 | 0.206 |
| Cd3d | 1 | 1.5944058 | 0.00E+00 | 0.575 | 0.117 |
| Cd8b1 | 1 | 1.5487759 | 0.00E+00 | 0.436 | 0.07 |
| Pdcd1 | 1 | 1.4021161 | 0.00E+00 | 0.349 | 0.055 |
| Ccl5 | 1 | 1.3945259 | 0.00E+00 | 0.511 | 0.238 |
| Trac | 1 | 1.386156 | 0.00E+00 | 0.409 | 0.081 |
| Nkg7 | 1 | 1.3523928 | 0.00E+00 | 0.846 | 0.312 |
| Gzma | 2 | 2.2895114 | 0.00E+00 | 0.791 | 0.129 |
| Ctla2a | 2 | 1.5998326 | 0.00E+00 | 0.784 | 0.237 |
| Ncr1 | 2 | 1.4823334 | 0.00E+00 | 0.344 | 0.05 |
| Gzmb | 2 | 1.4429917 | 0.00E+00 | 0.731 | 0.256 |
| Xcl1 | 2 | 1.4423387 | 0.00E+00 | 0.296 | 0.068 |
| Txk | 2 | 1.2925944 | 0.00E+00 | 0.44 | 0.127 |
| Gzmc | 2 | 1.2601545 | 0.00E+00 | 0.344 | 0.076 |
| Ctsw | 2 | 1.2167888 | 0.00E+00 | 0.392 | 0.112 |
| Car2 | 2 | 1.205531 | 0.00E+00 | 0.268 | 0.048 |
| AW112010 | 2 | 1.0909183 | 0.00E+00 | 0.954 | 0.651 |
| Ogn | 3 | 2.476344 | 0.00E+00 | 0.662 | 0.017 |
| Mgp | 3 | 2.4366741 | 0.00E+00 | 0.347 | 0.012 |
| Dcn | 3 | 2.3669042 | 0.00E+00 | 0.492 | 0.016 |
| Aspn | 3 | 2.1505621 | 0.00E+00 | 0.568 | 0.01 |
| Col1a2 | 3 | 2.0605998 | 0.00E+00 | 0.705 | 0.052 |
| Cyr61 | 3 | 2.0287407 | 0.00E+00 | 0.569 | 0.032 |
| Fosb | 3 | 1.9822744 | 0.00E+00 | 0.847 | 0.221 |
| Tmem176a | 3 | 1.9170166 | 0.00E+00 | 0.689 | 0.086 |
| Tmem176b | 3 | 1.9045199 | 0.00E+00 | 0.738 | 0.104 |
| Cald1 | 3 | 1.9027519 | 0.00E+00 | 0.684 | 0.062 |
| Il1b | 4 | 1.9732185 | 0.00E+00 | 0.762 | 0.215 |
| Thbs1 | 4 | 1.9261186 | 0.00E+00 | 0.37 | 0.044 |
| Cxcl2 | 4 | 1.6052605 | 0.00E+00 | 0.688 | 0.254 |
| Clec4e | 4 | 1.4501999 | 0.00E+00 | 0.361 | 0.072 |
| Cd14 | 4 | 1.3572954 | 0.00E+00 | 0.59 | 0.217 |
| Ms4a4c | 4 | 1.2103303 | 0.00E+00 | 0.465 | 0.172 |
| Ptgs2 | 4 | 1.1538446 | 0.00E+00 | 0.313 | 0.131 |
| Plac8 | 4 | 1.1348997 | 0.00E+00 | 0.781 | 0.477 |
| Ccl9 | 4 | 1.1059549 | 0.00E+00 | 0.438 | 0.176 |
| Cxcl10 | 4 | 1.1312562 | 1.03E−259 | 0.262 | 0.137 |
| Tm4sf1 | 5 | 1.6249885 | 0.00E+00 | 0.81 | 0.082 |
| Timp1 | 5 | 1.5111762 | 0.00E+00 | 0.588 | 0.035 |
| Rhox5 | 5 | 1.470481 | 0.00E+00 | 0.725 | 0.053 |
| Mt2 | 5 | 1.435948 | 0.00E+00 | 0.677 | 0.082 |
| Lgals7 | 5 | 1.4258289 | 0.00E+00 | 0.573 | 0.03 |
| Tnfrsf12a | 5 | 1.3805107 | 0.00E+00 | 0.659 | 0.047 |
| Hmga2 | 5 | 1.3750333 | 0.00E+00 | 0.628 | 0.038 |
| Rpl3l | 5 | 1.2806529 | 0.00E+00 | 0.621 | 0.034 |
| Mt1 | 5 | 1.2660327 | 0.00E+00 | 0.826 | 0.268 |
| Anxa3 | 5 | 1.2040939 | 0.00E+00 | 0.727 | 0.133 |
| Gatm | 6 | 1.2499137 | 0.00E+00 | 0.747 | 0.173 |
| C1qc | 6 | 1.2035207 | 0.00E+00 | 0.911 | 0.259 |
| C1qa | 6 | 1.2019306 | 0.00E+00 | 0.94 | 0.299 |
| C1qb | 6 | 1.1728409 | 0.00E+00 | 0.925 | 0.281 |
| Ccl12 | 6 | 1.1541201 | 0.00E+00 | 0.649 | 0.165 |
| Top2a | 6 | 1.1297705 | 0.00E+00 | 0.666 | 0.116 |
| Mki67 | 6 | 1.1007564 | 0.00E+00 | 0.625 | 0.097 |
| Ctsc | 6 | 1.0590708 | 0.00E+00 | 0.948 | 0.357 |
| Birc5 | 6 | 1.0377076 | 0.00E+00 | 0.532 | 0.078 |
| Ube2c | 6 | 0.9993304 | 0.00E+00 | 0.474 | 0.071 |
| Hist1h1b | 7 | 1.6942294 | 0.00E+00 | 0.547 | 0.074 |
| Hmgb2 | 7 | 1.6290841 | 0.00E+00 | 0.935 | 0.338 |
| Mki67 | 7 | 1.5959674 | 0.00E+00 | 0.59 | 0.1 |
| Top2a | 7 | 1.5748183 | 0.00E+00 | 0.643 | 0.118 |
| 2810417H13Rik | 7 | 1.5480054 | 0.00E+00 | 0.61 | 0.104 |
| Stmn1 | 7 | 1.4260729 | 0.00E+00 | 0.624 | 0.141 |
| Tubb5 | 7 | 1.4140022 | 0.00E+00 | 0.882 | 0.393 |
| Ube2c | 7 | 1.3745421 | 0.00E+00 | 0.402 | 0.075 |
| Trbc2 | 7 | 1.2288275 | 0.00E+00 | 0.846 | 0.256 |
| Birc5 | 7 | 1.2149915 | 0.00E+00 | 0.427 | 0.083 |
| Tnfrsf4 | 8 | 1.412908 | 0.00E+00 | 0.251 | 0.062 |
| Ccr7 | 8 | 1.3128144 | 0.00E+00 | 0.311 | 0.056 |
| Satb1 | 8 | 1.2846066 | 0.00E+00 | 0.407 | 0.134 |
| Il7r | 8 | 1.2615419 | 0.00E+00 | 0.279 | 0.07 |
| Cd2 | 8 | 1.1457939 | 0.00E+00 | 0.31 | 0.092 |
| Ets1 | 8 | 1.0442515 | 0.00E+00 | 0.415 | 0.184 |
| Cd3d | 8 | 0.9322417 | 0.00E+00 | 0.429 | 0.171 |
| Vps37b | 8 | 0.9704592 | 7.30E−294 | 0.466 | 0.245 |
| Ikzf2 | 8 | 1.1832411 | 3.53E−243 | 0.275 | 0.108 |
| Icos | 8 | 0.9550254 | 3.91E−208 | 0.29 | 0.126 |
| Cst3 | 9 | 2.6876227 | 0.00E+00 | 0.987 | 0.628 |
| Naaa | 9 | 1.8725512 | 0.00E+00 | 0.641 | 0.089 |
| H2-Ab1 | 9 | 1.7312111 | 0.00E+00 | 0.979 | 0.357 |
| H2-Eb1 | 9 | 1.7074564 | 0.00E+00 | 0.974 | 0.348 |
| H2-Aa | 9 | 1.6980918 | 0.00E+00 | 0.982 | 0.356 |
| Gm2a | 9 | 1.5040895 | 0.00E+00 | 0.653 | 0.136 |
| Xcr1 | 9 | 1.4764954 | 0.00E+00 | 0.358 | 0.004 |
| Cd74 | 9 | 1.4400809 | 0.00E+00 | 0.99 | 0.435 |
| Plbd1 | 9 | 1.3989306 | 0.00E+00 | 0.553 | 0.101 |
| Ifitm1 | 9 | 1.3490328 | 3.06E−156 | 0.331 | 0.172 |
| Gzma | 10 | 1.6582521 | 0.00E+00 | 0.854 | 0.187 |
| Stmn1 | 10 | 1.5492092 | 0.00E+00 | 0.719 | 0.148 |
| Hmgb2 | 10 | 1.5243548 | 0.00E+00 | 0.93 | 0.351 |
| Hist1h1b | 10 | 1.4670358 | 0.00E+00 | 0.52 | 0.085 |
| 2810417H13Rik | 10 | 1.461466 | 0.00E+00 | 0.62 | 0.114 |
| Mki67 | 10 | 1.3758438 | 0.00E+00 | 0.574 | 0.11 |
| Top2a | 10 | 1.3152939 | 0.00E+00 | 0.599 | 0.13 |
| Gzmc | 10 | 1.2718773 | 0.00E+00 | 0.465 | 0.097 |
| Tubb5 | 10 | 1.246692 | 0.00E+00 | 0.879 | 0.403 |
| Xcl1 | 10 | 1.2360102 | 0.00E+00 | 0.408 | 0.085 |
| S100a9 | 11 | 3.9735976 | 0.00E+00 | 0.976 | 0.025 |
| S100a8 | 11 | 3.212785 | 0.00E+00 | 0.868 | 0.028 |
| G0s2 | 11 | 2.3877348 | 0.00E+00 | 0.659 | 0.007 |
| Hdc | 11 | 1.489219 | 0.00E+00 | 0.421 | 0.016 |
| Il1b | 11 | 1.4709789 | 0.00E+00 | 0.917 | 0.241 |
| Cxcl2 | 11 | 1.4269986 | 0.00E+00 | 0.907 | 0.273 |
| Irg1 | 11 | 1.1824776 | 0.00E+00 | 0.49 | 0.116 |
| Il1r2 | 11 | 1.1778567 | 0.00E+00 | 0.322 | 0.031 |
| Rsad2 | 11 | 1.1508371 | 0.00E+00 | 0.332 | 0.073 |
| Ccl3 | 11 | 1.078948 | 0.00E+00 | 0.501 | 0.162 |
| Klk1 | 12 | 2.9407446 | 0.00E+00 | 0.69 | 0.001 |
| Siglech | 12 | 2.7625311 | 0.00E+00 | 0.731 | 0.002 |
| Ccr9 | 12 | 2.6723493 | 0.00E+00 | 0.676 | 0.002 |
| Slpi | 12 | 2.5504225 | 0.00E+00 | 0.564 | 0.022 |
| Cox6a2 | 12 | 2.3005591 | 0.00E+00 | 0.515 | 0.003 |
| Rnase6 | 12 | 2.140364 | 0.00E+00 | 0.556 | 0.025 |
| Tcf4 | 12 | 2.0934095 | 0.00E+00 | 0.754 | 0.149 |
| St8sia4 | 12 | 1.9286392 | 0.00E+00 | 0.621 | 0.087 |
| Mef2c | 12 | 1.8767946 | 0.00E+00 | 0.552 | 0.071 |
| Iglc3 | 12 | 1.7699907 | 0.00E+00 | 0.358 | 0.003 |
| Gzmd | 13 | 3.6010458 | 0.00E+00 | 0.945 | 0.044 |
| Gzmf | 13 | 3.5805919 | 0.00E+00 | 0.542 | 0.048 |
| Gzmg | 13 | 3.4254773 | 0.00E+00 | 0.431 | 0.007 |
| Gzmc | 13 | 3.4018323 | 0.00E+00 | 0.982 | 0.089 |
| Gzme | 13 | 3.0049935 | 0.00E+00 | 0.875 | 0.036 |
| Gzma | 13 | 2.0634696 | 0.00E+00 | 0.947 | 0.19 |
| Spp1 | 13 | 1.8116956 | 0.00E+00 | 0.975 | 0.475 |
| Gzmb | 13 | 1.6022698 | 0.00E+00 | 0.925 | 0.298 |
| Car2 | 13 | 1.5864498 | 0.00E+00 | 0.652 | 0.062 |
| Ctla2a | 13 | 1.4785427 | 0.00E+00 | 0.946 | 0.287 |
| Igkc | 14 | 3.7133022 | 0.00E+00 | 0.832 | 0.015 |
| Ebf1 | 14 | 2.1859315 | 0.00E+00 | 0.521 | 0.003 |
| Cd79a | 14 | 1.9989827 | 0.00E+00 | 0.464 | 0.002 |
| Ms4a1 | 14 | 1.8353139 | 0.00E+00 | 0.4 | 0.002 |
| Ighm | 14 | 1.710271 | 0.00E+00 | 0.439 | 0.093 |
| Cd79b | 14 | 1.6936116 | 0.00E+00 | 0.343 | 0.01 |
| Mef2c | 14 | 1.615267 | 0.00E+00 | 0.495 | 0.073 |
| Mzb1 | 14 | 1.4672477 | 0.00E+00 | 0.261 | 0.006 |
| Satb1 | 14 | 1.2327734 | 0.00E+00 | 0.477 | 0.138 |
| Dmxl1 | 14 | 1.020235 | 2.62E−178 | 0.257 | 0.079 |
| Cma1 | 15 | 5.1701725 | 0.00E+00 | 0.959 | 0.009 |
| Tpsab1 | 15 | 4.6569614 | 0.00E+00 | 0.854 | 0.006 |
| Cpa3 | 15 | 4.4827099 | 0.00E+00 | 0.909 | 0.003 |
| Mcpt4 | 15 | 4.3467735 | 0.00E+00 | 0.802 | 0.002 |

TABLE 3-continued

| Gene | Cluster | Log Fold Change | p_value | PCA1 | PCA2 |
|---|---|---|---|---|---|
| Tpsb2 | 15 | 4.0374796 | 0.00E+00 | 0.842 | 0.003 |
| Serpinb1a | 15 | 3.0235356 | 0.00E+00 | 0.718 | 0.014 |
| Hdc | 15 | 2.4511404 | 0.00E+00 | 0.6 | 0.022 |
| Fcer1a | 15 | 2.3809022 | 0.00E+00 | 0.504 | 0.001 |
| Ctsg | 15 | 2.3213802 | 0.00E+00 | 0.361 | 0.001 |
| Cyp11a1 | 15 | 2.3137841 | 0.00E+00 | 0.488 | 0.001 |
| Col1a2 | 16 | 1.0607779 | 0.00E+00 | 0.73 | 0.113 |
| Fosb | 16 | 1.0165505 | 0.00E+00 | 0.908 | 0.279 |
| Ogn | 16 | 0.972495 | 0.00E+00 | 0.608 | 0.078 |
| Fn1 | 16 | 0.9469112 | 0.00E+00 | 0.811 | 0.176 |
| Cyr61 | 16 | 0.9414953 | 0.00E+00 | 0.572 | 0.083 |
| Dcn | 16 | 0.9129313 | 0.00E+00 | 0.441 | 0.061 |
| Tmem176b | 16 | 0.825046 | 0.00E+00 | 0.746 | 0.163 |
| Egr1 | 16 | 0.9363004 | 5.73E−287 | 0.834 | 0.247 |
| Klf4 | 16 | 0.8515272 | 4.84E−251 | 0.772 | 0.229 |
| Neat1 | 16 | 0.8415144 | 8.79E−201 | 0.911 | 0.388 |
| mt-Cytb | 17 | 1.9028675 | 0.00E+00 | 1 | 0.958 |
| mt-Nd2 | 17 | 1.8390858 | 0.00E+00 | 1 | 0.92 |
| mt-Nd4 | 17 | 1.712595 | 0.00E+00 | 1 | 0.922 |
| mt-Atp6 | 17 | 1.68546 | 0.00E+00 | 1 | 0.998 |
| mt-Co2 | 17 | 1.5856967 | 0.00E+00 | 1 | 0.995 |
| mt-Co3 | 17 | 1.5489455 | 0.00E+00 | 1 | 0.998 |
| mt-Nd1 | 17 | 1.7418684 | 6.67E−304 | 1 | 0.899 |
| mt-Nd3 | 17 | 1.7583281 | 6.69E−274 | 0.957 | 0.542 |
| mt-Nd5 | 17 | 1.6035868 | 3.50E−219 | 0.89 | 0.484 |
| mt-Nd4l | 17 | 1.5274672 | 2.51E−171 | 0.669 | 0.247 |
| Il12b | 18 | 2.648173 | 0.00E+00 | 0.397 | 0.002 |
| Tbc1d4 | 18 | 2.5468174 | 0.00E+00 | 0.722 | 0.025 |
| Ccl22 | 18 | 2.533914 | 0.00E+00 | 0.537 | 0.003 |
| Fscn1 | 18 | 2.4947644 | 0.00E+00 | 0.585 | 0.02 |
| Ccr7 | 18 | 2.4726716 | 0.00E+00 | 0.804 | 0.062 |
| Cacnb3 | 18 | 1.7793511 | 0.00E+00 | 0.415 | 0.007 |
| Tmem123 | 18 | 1.8677586 | 2.14E−232 | 0.64 | 0.125 |
| Cst3 | 18 | 2.2128509 | 1.60E−184 | 0.96 | 0.638 |
| Ccl5 | 18 | 2.0516679 | 2.07E−170 | 0.815 | 0.274 |
| Epsti1 | 18 | 1.7665033 | 1.02E−107 | 0.447 | 0.112 |
| Ctsk | 19 | 4.2669091 | 0.00E+00 | 0.782 | 0.003 |
| Acp5 | 19 | 3.9139649 | 0.00E+00 | 0.924 | 0.028 |
| Mmp9 | 19 | 3.5317529 | 0.00E+00 | 0.731 | 0.006 |
| Atp6v0d2 | 19 | 1.9512049 | 0.00E+00 | 0.655 | 0.002 |
| Lpl | 19 | 1.8999571 | 0.00E+00 | 0.706 | 0.028 |
| Slc9b2 | 19 | 1.7372816 | 0.00E+00 | 0.538 | 0.003 |
| Jdp2 | 19 | 1.5506153 | 2.04E−254 | 0.613 | 0.035 |
| Chchd10 | 19 | 1.5819746 | 4.09E−194 | 0.655 | 0.052 |
| Atp6v1b2 | 19 | 1.6378957 | 2.43E−123 | 0.731 | 0.099 |
| Ifi30 | 19 | 1.5867604 | 1.26E−84 | 0.933 | 0.245 |
| Fabp4 | 20 | 3.9112285 | 0.00E+00 | 0.443 | 0.01 |
| Sparc | 20 | 3.5385908 | 0.00E+00 | 0.918 | 0.05 |
| Igfbp7 | 20 | 3.2347598 | 0.00E+00 | 0.918 | 0.015 |
| Igfbp3 | 20 | 2.7632253 | 0.00E+00 | 0.392 | 0 |
| Bgn | 20 | 2.6396611 | 0.00E+00 | 0.557 | 0.016 |
| Col1a1 | 20 | 2.9717075 | 3.28E−238 | 0.464 | 0.018 |
| Col3a1 | 20 | 3.3234652 | 2.39E−125 | 0.485 | 0.037 |
| Rarres2 | 20 | 2.7169551 | 4.70E−103 | 0.515 | 0.051 |
| Timp1 | 20 | 2.8844734 | 2.51E−76 | 0.505 | 0.064 |
| Cxcl14 | 20 | 2.7988039 | 6.40E−59 | 0.371 | 0.044 |

The IFNγ response was further evaluated across the treatment groups. For each treatment group, tumor-associated macrophages were identified based on F4/80 antigen expression. Scores for IFNγ signature were calculated by taking the mean expression of IFNγ signature genes in cluster of cells identified as macrophages, based on F4/80 expression. Treatment with the combination of anti-murine CD39 and anti-murine PD-1 showed an increase in IFNγ response as compared to the response observed by anti-murine CD39 or anti-murine PD-1 alone (FIG. 24). These data indicated that anti-CD39 treatment augments the anti-PD1 response.

The functional effect of anti-CD39 on the anti-PD1-induced TME effects was further evaluated across cell types in the TME. The combination of anti-CD39 and anti-PD1 treatment was observed to modify the anti-PD1-induced TME effects most strongly in dendritic cells and lymphocyte infiltrates (FIG. 25).

Although the foregoing invention has been described in some detail by way of illustration and example for purposes of clarity of understanding, the descriptions and examples should not be construed as limiting the scope of the disclosure. The disclosures of all patent and scientific literature cited herein are expressly incorporated in their entirety by reference.

V. Table of Sequences

| SEQ ID NO | Clone No | Description | Sequence |
|---|---|---|---|
| 1 | 1 | VH CDR1 | GTFSSYAIS |
| 2 | 1 | VH CDR2 | SIIPIFGTANYAQKFQG |
| 3 | 1 | VH CDR3 | AREAGYYRYRYFDL |
| 4 | 1 | VL CDR1 | RASQSVSSNLA |
| 5 | 1 | VL CDR2 | GASTRAT |
| 6 | 1 | VL CDR3 | QQHALWPLT |
| 7 | 1 | VH FR1 | QVQLVQSGAEVKKPGSSVKVSCKASG |
| 8 | 1 | VH FR2 | WVRQAPGQGLEWMG |
| 9 | 1 | VH FR3 | RVTITADESTSTAYMELSSLRSEDTAVYYC |
| 10 | 1 | VH FR4 | WGRGTLVTVSS |
| 11 | 1 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAGCTATGCTATCAGCTGGGTGCGACAGGCCCCTGGACA AGGGCTTGAGTGGATGGGAAGCATCATCCCTATCTTTGGTACA |

V. Table of Sequences

| SEQ ID NO | Clone No | Description | Sequence |
|---|---|---|---|
| | | | GCAAACTACGCACAGAAGTTCCAGGGCAGAGTCACGATTACC GCGGACGAATCCACGAGCACAGCCTACATGGAGCTGAGCAGC CTGAGATCTGAGGACACGGCGGTGTACTACTGCGCCAGAGAA GCCGGATACTACCGCTACCGATACTTCGACCTATGGGGGAGAG GTACCTTGGTCACCGTCTCCTCA |
| 12 | 1 | VH Protein | QVQLVQSGAEVKKPGSSVKVSCKASGGTFSSYAISWVRQAPGQG LEWMGSIIPIFGTANYAQKFQGRVTITADESTSTAYMELSSLRSED TAVYYCAREAGYYRYRYFDLWGRGTLVTVSS |
| 13 | 1 | VL FR1 | EIVMTQSPATLSVSPGERATLSC |
| 14 | 1 | VL FR2 | WYQQKPGQAPRLLIY |
| 15 | 1 | VL FR3 | GIPARFSGSGSGTEFTLTISSLQSEDFAVYYC |
| 16 | 1 | VL FR4 | FGGGTKVEIK |
| 17 | 1 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT CCCAGGCTCCTCATCTATGGTGCATCCACCAGGGCCACTGGTA TCCCAGCCAGGTTCAGTGGCAGTGGGTCTGGGACAGAGTTCAC TCTCACCATCAGCAGCCTGCAGTCTGAAGATTTTGCAGTTTATT ACTGTCAGCAGCACGCCCTCTGGCCTCTCACTTTTGGCGGAGG GACCAAGGTTGAGATCAAA |
| 18 | 1 | VL Protein | EIVMTQSPATLSVSPGERATLSCRASQSVSSNLAWYQQKPGQAPR LLIYGASTRATGIPARFSGSGSGTEFTLTISSLQSEDFAVYYCQQHA LWPLTFGGGTKVEIK |
| 19-100: Not used | | | |
| 101 | 2 | VH CDR1 | GTFSSYAIG |
| 102 | 2 | VH CDR2 | GIIPIFGTANYAQKFQG |
| 103 | 2 | VH CDR3 | ARDPVRRSPFDI |
| 104 | 2 | VL CDR1 | RASQSVSSYLA |
| 105 | 2 | VL CDR2 | DSSNRAT |
| 106 | 2 | VL CDR3 | QQSFLWPRT |
| 107 | 2 | VH FR1 | QVQLVQSGAEVKKPGSSVKVSCKASG |
| 108 | 2 | VH FR2 | WVRQAPGQGLEWMG |
| 109 | 2 | VH FR3 | RVTITADESTSTAYMELSSLRSEDTAVYYC |
| 110 | 2 | VH FR4 | WGQGTMVTVSS |
| 111 | 2 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAGCTATGCTATCGGCTGGGTGCGACAGGCCCCTGGACA AGGGCTTGAGTGGATGGGAGGGATCATCCCTATCTTTGGTACA GCAAACTACGCACAGAAGTTCCAGGGCAGAGTCACGATTACC GCGGACGAATCCACGAGCACAGCCTACATGGAGCTGAGCAGC CTGAGATCTGAGGACACGGCGGTGTACTACTGCGCCAGAGATC CGGTGAGAAGAAGCCCATTCGACATATGGGGTCAGGGTACAA TGGTCACCGTCTCCTCA |
| 112 | 2 | VH Protein | QVQLVQSGAEVKKPGSSVKVSCKASGGTFSSYAIGWVRQAPGQG LEWMGGIIPIFGTANYAQKFQGRVTITADESTSTAYMELSSLRSED TAVYYCARDPVRRSPFDIWGQGTMVTVSS |
| 113 | 2 | VL FR1 | EIVLTQSPATLSLSPGERATLSC |
| 114 | 2 | VL FR2 | WYQQKPGQAPRLLIY |
| 115 | 2 | VL FR3 | GIPARFSGSGSGTDFTLTISSLEPEDFAVYYC |

V. Table of Sequences

| SEQ ID NO | Clone No | Description | Sequence |
|---|---|---|---|
| 116 | 2 | VL FR4 | FGGGTKVEIK |
| 117 | 2 | VL DNA | GAAATTGTGTTGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATTCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGTCCTTCCTCTGGCCTAGGACTTTTGGCGGAGG GACCAAGGTTGAGATCAAA |
| 118 | 2 | VL Protein | EIVLTQSPATLSLSPGERATLSCRASQSVSSYLAWYQQKPGQAPRL LIYDSSNRATGIPARFSGSGSGTDFTLTISSLEPEDFAVYYCQQSFL WPRTFGGGTKVEIK |
| 119-200: Not used | | | |
| 201 | 3 | VH CDR1 | FTFSSYAMS |
| 202 | 3 | VH CDR2 | TISGSGGSTYYADSVKG |
| 203 | 3 | VH CDR3 | AKGPRYDSSGYRWRYGMDV |
| 204 | 3 | VL CDR1 | RASQSISSYLN |
| 205 | 3 | VL CDR2 | AASSLQS |
| 206 | 3 | VL CDR3 | QQLYVDPPWT |
| 207 | 3 | VH FR1 | EVQLLESGGGLVQPGGSLRLSCAASG |
| 208 | 3 | VH FR2 | WVRQAPGKGLEWVS |
| 209 | 3 | VH FR3 | RFTISRDNSKNTLYLQMNSLRAEDTAVYYC |
| 210 | 3 | VH FR4 | WGQGTTVTVSS |
| 211 | 3 | VH DNA | GAGGTGCAGCTGTTGGAGTCTGGGGGAGGCTTGGTACAACCTG GGGGGTCCCTGAGACTCTCCTGTGCAGCCTCTGGATTCACCTTT AGCAGCTATGCCATGAGCTGGGTCCGCCAGGCTCCAGGGAAG GGGCTGGAGTGGGTCTCAACCATTAGTGGTAGTGGTGGTAGCA CATACTACGCAGACTCCGTGAAGGGCCGGTTCACCATCTCCAG AGACAATTCCAAGAACACGCTGTATCTGCAAATGAACAGCCTG AGAGCCGAGGACACGGCGGTGTACTACTGCGCCAAGGGCCCC AGATACGACAGCAGCGGATACCGATGGAGATACGGAATGGAC GTATGGGGCCAGGGAACAACTGTCACCGTCTCCTCA |
| 212 | 3 | VH Protein | EVQLLESGGGLVQPGGSLRLSCAASGFTFSSYAMSWVRQAPGKG LEWVSTISGSGGSTYYADSVKGRFTISRDNSKNTLYLQMNSLRAE DTAVYYCAKGPRYDSSGYRWRYGMDVWGQGTTVTVSS |
| 213 | 3 | VL FR1 | DIQMTQSPSSLSASVGDRVTITC |
| 214 | 3 | VL FR2 | WYQQKPGKAPKLLIY |
| 215 | 3 | VL FR3 | GVPSRFSGSGSGTDFTLTISSLQPEDFATYYC |
| 216 | 3 | VL FR4 | FGGGTKVEIK |
| 217 | 3 | VL DNA | GACATCCAGATGACCCAGTCTCCATCCTCCCTGTCTGCATCTGT AGGAGACAGAGTCACCATCACTTGCCGGGCAAGTCAGAGCATT AGCAGCTATTTAAATTGGTATCAGCAGAAACCAGGGAAAGCCC CTAAGCTCCTGATCTATGCTGCATCCAGTTTGCAAAGTGGGGT CCCATCAAGGTTCAGTGGCAGTGGATCTGGGACAGATTTCACT CTCACCATCAGCAGTCTGCAACCTGAAGATTTTGCAACTTACT ACTGTCAGCAACTATATGTCGACCCTCCTTGGACTTTCGGCGG AGGGACCAAGGTGGAGATCAAA |

| | | | V. Table of Sequences |
|---|---|---|---|
| SEQ ID NO | Clone No | Description | Sequence |
| 218 | 3 | VL Protein | DIQMTQSPSSLSASVGDRVTITCRASQSISSYLNWYQQKPGKAPKL LIYAASSLQSGVPSRFSGSGSGTDFTLTISSLQPEDFATYYCQQLYV DPPWTFGGGTKVEIK |
| 219-300: Not used | | | |
| 301 | 4 | VH CDR1 | FTFSSYAMS |
| 302 | 4 | VH CDR2 | AISASGGSTYYADSVKG |
| 303 | 4 | VH CDR3 | AKGPRYDSSGYRWRYGMDV |
| 304 | 4 | VL CDR1 | RASQSISSYLN |
| 305 | 4 | VL CDR2 | AASSLQS |
| 306 | 4 | VL CDR3 | QQLALTPYT |
| 307 | 4 | VH FR1 | EVQLLESGGGLVQPGGSLRLSCAASG |
| 308 | 4 | VH FR2 | WVRQAPGKGLEWVS |
| 309 | 4 | VH FR3 | RFTISRDNSKNTLYLQMNSLRAEDTAVYYC |
| 310 | 4 | VH FR4 | WGQGTTVTVSS |
| 311 | 4 | VH DNA | GAGGTGCAGCTGTTGGAGTCTGGGGGAGGCTTGGTACAGCCTG GGGGGTCCCTGAGACTCTCCTGTGCAGCCTCTGGATTCACCTTT AGCAGCTATGCCATGAGCTGGGTCCGCCAGGCTCCAGGGAAG GGGCTGGAGTGGGTCTCAGCTATTAGTGCTAGTGGTGGTAGCA CATACTACGCAGACTCCGTGAAGGGCCGGTTCACCATCTCCAG AGACAATTCCAAGAACACGCTGTATCTGCAAATGAACAGCCTG AGAGCCGAGGACACGGCGGTGTACTACTGCGCCAAGGGCCCC AGATACGACAGCAGCGGATACCGATGGAGATACGGAATGGAC GTATGGGGCCAGGGAACAACTGTCACCGTCTCCTCA |
| 312 | 4 | VH Protein | EVQLLESGGGLVQPGGSLRLSCAASGFTFSSYAMSWVRQAPGKG LEWVSAISASGGSTYYADSVKGRFTISRDNSKNTLYLQMNSLRAE DTAVYYCAKGPRYDSSGYRWRYGMDVWGQGTTVTVSS |
| 313 | 4 | VL FR1 | DIQMTQSPSSLSASVGDRVTITC |
| 314 | 4 | VL FR2 | WYQQKPGKAPKLLIY |
| 315 | 4 | VL FR3 | GVPSRFSGSGSGTDFTLTISSLQPEDFATYYC |
| 316 | 4 | VL FR4 | FGGGTKVEIK |
| 317 | 4 | VL DNA | GACATCCAGATGACCCAGTCTCCATCCTCCCTGTCTGCATCTGT AGGAGACAGAGTCACCATCACTTGCCGGGCAAGTCAGAGCATT AGCAGCTATTTAAATTGGTATCAGCAGAAACCAGGGAAAGCCC CTAAGCTCCTGATCTATGCTGCATCCAGTTTGCAAAGTGGGGT CCCATCAAGGTTCAGTGGCAGTGGATCTGGGACAGATTTCACT CTCACCATCAGCAGTCTGCAACCTGAAGATTTTGCAACTTACT ACTGTCAGCAACTAGCCCTCACTCCTTACACTTTTGGCGGAGG GACCAAGGTTGAGATCAAA |
| 318 | 4 | VL Protein | DIQMTQSPSSLSASVGDRVTITCRASQSISSYLNWYQQKPGKAPKL LIYAASSLQSGVPSRFSGSGSGTDFTLTISSLQPEDFATYYCQQLAL TPYTFGGGTKVEIK |
| 319-400: Not used | | | |
| 401 | 5 | VH CDR1 | YTFTGYYMH |
| 402 | 5 | VH CDR2 | WINPNSGGTNYAQKFQG |
| 403 | 5 | VH CDR3 | ARDAPFYTWDHYYGMDV |
| 404 | 5 | VL CDR1 | QASQDISNYLN |
| 405 | 5 | VL CDR2 | DASNLAT |

V. Table of Sequences

| SEQ ID NO | Clone No | Description | Sequence |
|---|---|---|---|
| 406 | 5 | VL CDR3 | QQLYHLPIT |
| 407 | 5 | VH FR1 | QVQLVQSGAEVKKPGASVKVSCKASG |
| 408 | 5 | VH FR2 | WVRQAPGQGLEWMG |
| 409 | 5 | VH FR3 | RVTMTRDTSISTAYMELSRLRSDDTAVYYC |
| 410 | 5 | VH FR4 | WGQGTTVTVSS |
| 411 | 5 | VH DNA | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCGGTGTACTACTGCGCCAGAGATGCTCCTTTCTACACCTGGGATCACTACTACGGAATGGACGTATGGGGCCAGGGAACAACTGTCACCGTCTCCTCA |
| 412 | 5 | VH Protein | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDAPFYTWDHYYGMDVWGQGTTVTVSS |
| 413 | 5 | VL FR1 | DIQMTQSPSSLSASVGDRVTITC |
| 414 | 5 | VL FR2 | WYQQKPGKAPKLLIY |
| 415 | 5 | VL FR3 | GVPSRFSGSGSGTDFTFTISSLQPEDIATYYC |
| 416 | 5 | VL FR4 | FGGGTKVEIK |
| 417 | 5 | VL DNA | GACATCCAGATGACCCAGTCTCCATCCTCCCTGTCTGCATCTGTAGGAGACAGAGTCACCATCACTTGCCAGGCGAGTCAGGACATTAGCAACTATTTAAATTGGTATCAGCAGAAACCAGGGAAAGCCCCTAAGCTCCTGATCTACGATGCATCCAATTTGGCAACAGGGGTCCCATCAAGGTTCAGTGGAAGTGGATCTGGGACAGATTTTACTTTCACCATCAGCAGCCTGCAGCCTGAAGATATTGCAACATATTACTGTCAGCAGCTCTACCACCTCCCTATCACTTTTGGCGGAGGGACCAAGGTTGAGATCAAA |
| 418 | 5 | VL Protein | DIQMTQSPSSLSASVGDRVTITCQASQDISNYLNWYQQKPGKAPKLLIYDASNLATGVPSRFSGSGSGTDFTFTISSLQPEDIATYYCQQLYHLPITFGGGTKVEIK |
| 419-500: Not used | | | |
| 501 | 6 | VH CDR1 | FTFSSYGMS |
| 502 | 6 | VH CDR2 | NIKQDGSEKYYVDSVKG |
| 503 | 6 | VH CDR3 | ARDFTRWSHVNWFDP |
| 504 | 6 | VL CDR1 | RASQSVSSSLA |
| 505 | 6 | VL CDR2 | GASTRAT |
| 506 | 6 | VL CDR3 | QQYYHHPYT |
| 507 | 6 | VH FR1 | EVQLVESGGGLVQPGGSLRLSCAASG |
| 508 | 6 | VH FR2 | WVRQAPGKGLEWVA |
| 509 | 6 | VH FR3 | RFTISRDNAKNSLYLQMNSLRAEDTAVYYC |
| 510 | 6 | VH FR4 | WGQGTLVTVSS |
| 511 | 6 | VH DNA | GAGGTGCAGCTGGTGGAGTCTGGGGGAGGCTTGGTCCAGCCTGGGGGGTCCCTGAGACTCTCCTGTGCAGCCTCTGGATTCACCTTTAGTAGCTATGGGATGAGCTGGGTCCGCCAGGCTCCAGGGAAGGGGCTGGAGTGGGTGGCCAACATAAAGCAAGATGGAAGTGAGAAATACTATGTGGACTCTGTGAAGGGCCGATTCACCATCTCCA |

V. Table of Sequences

| SEQ ID NO | Clone No | Description | Sequence |
|---|---|---|---|
| | | | GAGACAACGCCAAGAACTCACTGTATCTGCAAATGAACAGCCT GAGAGCCGAGGACACGGCGGTGTACTACTGCGCTAGGGATTTC ACTAGATGGTCCCACGTGAACTGGTTTGATCCCTGGGGACAGG GTACATTGGTCACCGTCTCCTCA |
| 512 | 6 | VH Protein | EVQLVESGGGLVQPGGSLRLSCAASGFTFSSYGMSWVRQAPGKG LEWVANIKQDGSEKYYVDSVKGRFTISRDNAKNSLYLQMNSLRA EDTAVYYCARDFTRWSHVNWFDPWGQGTLVTVSS |
| 513 | 6 | VL FR1 | EIVMTQSPATLSVSPGERATLSC |
| 514 | 6 | VL FR2 | WYQQKPGQAPRLLIF |
| 515 | 6 | VL FR3 | GIPARFSGSGSGTEFTLTISSLQSEDFAVYYC |
| 516 | 6 | VL FR4 | FGGGTKVEIK |
| 517 | 6 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAGCTTAGCCTGGTACCAGCAGAAACCTGGCCAGGCT CCCAGGCTCCTCATCTTTGGTGCATCCACCAGGGCCACTGGTAT CCCAGCCAGGTTCAGTGGCAGTGGGTCTGGGACAGAGTTCACT CTCACCATCAGCAGCCTGCAGTCTGAAGATTTTGCAGTTTATTA CTGTCAGCAGTACTACCACCACCCTTACACTTTTGGCGGAGGG ACCAAGGTTGAGATCAAA |
| 518 | 6 | VL Protein | EIVMTQSPATLSVSPGERATLSCRASQSVSSSLAWYQQKPGQAPR LLIFGASTRATGIPARFSGSGSGTEFTLTISSLQSEDFAVYYCQQYY HHPYTFGGGTKVEIK |
| 519-600: Not used | | | |
| 601 | 7 | VH CDR1 | YSISSGYYWA |
| 602 | 7 | VH CDR2 | SIYHSGSTYYNPSLKS |
| 603 | 7 | VH CDR3 | ARGAGHRQFAFDI |
| 604 | 7 | VL CDR1 | KSSQSVLYSSNNKNYLA |
| 605 | 7 | VL CDR2 | WASTRES |
| 606 | 7 | VL CDR3 | QQFASSPWT |
| 607 | 7 | VH FR1 | QVQLQESGPGLVKPSETLSLTCAVSG |
| 608 | 7 | VH FR2 | WIRQPPGKGLEWIG |
| 609 | 7 | VH FR3 | RVTISVDTSKNQFSLKLSSVTAADTAVYYC |
| 610 | 7 | VH FR4 | WGQGTMVTVSS |
| 611 | 7 | VH DNA | CAGGTGCAGCTGCAGGAGTCGGGCCCAGGACTGGTGAAGCCTT CGGAGACCCTGTCCCTCACCTGCGCTGTCTCTGGTTACTCCATC AGCAGTGGTTACTACTGGGCTTGGATCCGGCAGCCCCCAGGGA AGGGGCTGGAGTGGATTGGGAGTATCTATCATAGTGGGAGCAC CTACTACAACCCGTCCCTCAAGAGTCGAGTCACCATATCAGTA GACACGTCCAAGAACCAGTTCTCCCTGAAGCTGAGTTCTGTGA CCGCCGCAGACACGGCGGTGTACTACTGCGCCAGAGGTGCCGG ACACAGACAGTTCGCATTCGATATCTGGGGTCAGGGTACAATG GTCACCGTCTCCTCA |
| 612 | 7 | VH Protein | QVQLQESGPGLVKPSETLSLTCAVSGYSISSGYYWAWIRQPPGKG LEWIGSIYHSGSTYYNPSLKSRVTISVDTSKNQFSLKLSSVTAADT AVYYCARGAGHRQFAFDIWGQGTMVTVSS |
| 613 | 7 | VL FR1 | DIVMTQSPDSLAVSLGERATINC |
| 614 | 7 | VL FR2 | WYQQKPGQPPKLLIY |
| 615 | 7 | VL FR3 | GVPDRFSGSGSGTDFTLTISSLQAEDVAVYYC |
| 616 | 7 | VL FR4 | FGGGTKVEIK |

V. Table of Sequences

| SEQ ID NO | Clone No | Description | Sequence |
|---|---|---|---|
| 617 | 7 | VL DNA | GACATCGTGATGACCCAGTCTCCAGACTCCCTGGCTGTGTCTCT GGGCGAGAGGGCCACCATCAACTGCAAGTCCAGCCAGAGTGT TTTATACAGCTCCAACAATAAGAACTACTTAGCTTGGTACCAG CAGAAACCAGGACAGCCTCCTAAGCTGCTCATTTACTGGGCAT CTACCCGGGAATCCGGGGTCCCTGACCGATTCAGTGGCAGCGG GTCTGGGACAGATTTCACTCTCACCATCAGCAGCCTGCAGGCT GAAGATGTGGCAGTTTATTACTGTCAGCAGTTCGCCAGTTCCC CTTGGACTTTTGGCGGAGGGACCAAGGTTGAGATCAAA |
| 618 | 7 | VL Protein | DIVMTQSPDSLAVSLGERATINCKSSQSVLYSSNNKNYLAWYQQ KPGQPPKLLIYWASTRESGVPDRFSGSGSGTDFTLTISSLQAEDVA VYYCQQFASSPWTFGGGTKVEIK |
| 619-700: Not used | | | |
| 701 | 8 | VH CDR1 | GSISSSSYYWG |
| 702 | 8 | VH CDR2 | SIYYSGSTYYNPSLKS |
| 703 | 8 | VH CDR3 | ARGSPTYHDFDL |
| 704 | 8 | VL CDR1 | RASQSVSSYLA |
| 705 | 8 | VL CDR2 | DASNRAT |
| 706 | 8 | VL CDR3 | QQRAIWPPT |
| 707 | 8 | VH FR1 | QLQLQESGPGLVKPSETLSLTCTVSG |
| 708 | 8 | VH FR2 | WIRQPPGKGLEWIG |
| 709 | 8 | VH FR3 | RVTISVDTSKNQFSLKLSSVTAADTAVYYC |
| 710 | 8 | VH FR4 | WGRGTLVTVSS |
| 711 | 8 | VH DNA | CAGCTGCAGCTGCAGGAGTCGGGCCCAGGACTGGTGAAGCCTT CGGAGACCCTGTCCCTCACCTGCACTGTCTCTGGTGGCTCCATC AGCAGTAGTAGTTACTACTGGGGCTGGATCCGCCAGCCCCCAG GGAAGGGGCTGGAGTGGATTGGGAGTATCTATTATAGTGGGA GCACCTACTACAACCCGTCCCTCAAGAGTCGAGTCACCATATC CGTAGACACGTCCAAGAACCAGTTCTCCCTGAAGCTGAGTTCT GTGACCGCCGCAGACACGGCGGTGTACTACTGCGCCAGAGGTT CCCCTACATACCACGACTTCGACCTATGGGGAGAGGTACCTT GGTCACCGTCTCCTCA |
| 712 | 8 | VH Protein | QLQLQESGPGLVKPSETLSLTCTVSGGSISSSSYYWGWIRQPPGKG LEWIGSIYYSGSTYYNPSLKSRVTISVDTSKNQFSLKLSSVTAADT AVYYCARGSPTYHDFDLWGRGTLVTVSS |
| 713 | 8 | VL FR1 | EIVLTQSPATLSLSPGERATLSC |
| 714 | 8 | VL FR2 | WYQQKPGQAPRLLIY |
| 715 | 8 | VL FR3 | GIPARFSGSGSGTDFTLTISSLEPEDFAVYYC |
| 716 | 8 | VL FR4 | FGGGTKVEIK |
| 717 | 8 | VL DNA | GAAATTGTGTTGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATGCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGAGCCATCTGGCCTCCTACTTTTGGCGGAGG GACCAAGGTTGAGATCAAA |

V. Table of Sequences

| SEQ ID NO | Clone No | Description | Sequence |
|---|---|---|---|
| 718 | 8 | VL Protein | EIVLTQSPATLSLSPGERATLSCRASQSVSSYLAWYQQKPGQAPRLLIYDASNRATGIPARFSGSGSGTDFTLTISSLEPEDFAVYYCQQRAIWPPTFGGGTKVEIK |
| 719-800: Not used | | | |
| 801 | 9 | VH CDR1 | YSISSGYYWA |
| 802 | 9 | VH CDR2 | SIYHSGSTYYNPSLKS |
| 803 | 9 | VH CDR3 | ARGAGHRQFAFDI |
| 804 | 9 | VL CDR1 | KSSQSVLYSSNNKNYLA |
| 805 | 9 | VL CDR2 | WASTRES |
| 806 | 9 | VL CDR3 | QQFHFTPWT |
| 807 | 9 | VH FR1 | QVQLQESGPGLVKPSETLSLTCAVSG |
| 808 | 9 | VH FR2 | WIRQPPGKGLEWIG |
| 809 | 9 | VH FR3 | RVTISVDTSKNQFSLKLSSVTAADTAVYYC |
| 810 | 9 | VH FR4 | WGQGTMVTVSS |
| 811 | 9 | VH DNA | CAGGTGCAGCTGCAGGAGTCGGGCCCAGGACTGGTGAAGCCTTCGGAGACCCTGTCCCTCACCTGCGCTGTCTCTGGTTACTCCATCAGCAGTGGTTACTACTGGGCTTGGATCCGGCAGCCCCCAGGGAAGGGGCTGGAGTGGATTGGGAGTATCTATCATAGTGGGAGCACCTACTACAACCCGTCCCTCAAGAGTCGAGTCACCATATCAGTAGACACGTCCAAGAACCAGTTCTCCCTGAAGCTGAGTTCTGTGACCGCCGCAGACACGGCGGTGTACTACTGCGCCAGAGGTGCCGGACACAGACAGTTCGCATTCGATATCTGGGGTCAGGGTACAATGGTCACCGTCTCCTCA |
| 812 | 9 | VH Protein | QVQLQESGPGLVKPSETLSLTCAVSGYSISSGYYWAWIRQPPGKGLEWIGSIYHSGSTYYNPSLKSRVTISVDTSKNQFSLKLSSVTAADTAVYYCARGAGHRQFAFDIWGQGTMVTVSS |
| 813 | 9 | VL FR1 | DIVMTQSPDSLAVSLGERATINC |
| 814 | 9 | VL FR2 | WYQQKPGQPPKLLIY |
| 815 | 9 | VL FR3 | GVPDRFSGSGSGTDFTLTISSLQAEDVAVYYC |
| 816 | 9 | VL FR4 | FGGGTKVEIK |
| 817 | 9 | VL DNA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATAAGAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAGTTCCACTTCACTCCTTGGACTTTTGGCGGAGGGACCAAGGTTGAGATCAAA |
| 818 | 9 | VL Protein | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFHFTPWTFGGGTKVEIK |
| 819-900 not used | | | |
| 901 | 10 | VH CDR1 | GTFSNYAIS |
| 902 | 10 | VH CDR2 | GIIPIFGTANYAQKFQG |
| 903 | 10 | VH CDR3 | ARPRGDYSGYDAGPIDY |
| 904 | 10 | VL CDR1 | RASQSVSSYLA |
| 905 | 10 | VL CDR2 | DASNRAT |

V. Table of Sequences

| SEQ ID NO | Clone No | Description | Sequence |
|---|---|---|---|
| 906 | 10 | VL CDR3 | QQRFHFPPT |
| 907 | 10 | VH FR1 | QVQLVQSGAEVKKPGSSVKVSCKASG |
| 908 | 10 | VH FR2 | WVRQAPGQGLEWMG |
| 909 | 10 | VH FR3 | RVTITADESTSTAYMELSSLRSEDTAVYYC |
| 910 | 10 | VH FR4 | WGQGTLVTVSS |
| 911 | 10 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAACTATGCTATCAGCTGGGTGCGACAGGCCCCTGGACA AGGGCTTGAGTGGATGGGAGGGATCATCCCTATCTTTGGTACA GCAAACTACGCACAGAAGTTCCAGGGCAGAGTCACGATTACC GCGGACGAATCCACGAGCACAGCCTACATGGAGCTGAGCAGC CTGAGATCTGAGGACACGGCGGTGTACTACTGCGCCAGACCCA GAGGCGACTACAGCGGATACGACGCAGGTCCCATTGACTACTG GGGACAGGGTACATTGGTCACCGTCTCCTCA |
| 912 | 10 | VH Protein | QVQLVQSGAEVKKPGSSVKVSCKASGGTFSNYAISWVRQAPGQG LEWMGGIIPIFGTANYAQKFQGRVTITADESTSTAYMELSSLRSED TAVYYCARPRGDYSGYDAGPIDYWGQGTLVTVSS |
| 913 | 10 | VL FR1 | EIVLTQSPATLSLSPGERATLSC |
| 914 | 10 | VL FR2 | WYQQKPGQAPRLLIY |
| 915 | 10 | VL FR3 | GIPARFSGSGSGTDFTLTISSLEPEDFAVYYC |
| 916 | 10 | VL FR4 | FGGGTKVEIK |
| 917 | 10 | VL DNA | GAAATTGTGTTGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATGCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGATTCCACTTCCCTCCTACTTTTGGCGGAGG GACCAAGGTTGAGATCAAA |
| 918 | 10 | VL Protein | EIVLTQSPATLSLSPGERATLSCRASQSVSSYLAWYQQKPGQAPRL LIYDASNRATGIPARFSGSGSGTDFTLTISSLEPEDFAVYYCQQRFH FPPTFGGGTKVEIK |
| 919-1000 | | not used | |
| 1001 | 11 | VH CDR1 | GTFSNYAIS |
| 1002 | 11 | VH CDR2 | GIIPIFGTANYAQKFQG |
| 1003 | 11 | VH CDR3 | ARPRGDYSGYDAGPIDY |
| 1004 | 11 | VL CDR1 | RASQSVSSYLA |
| 1005 | 11 | VL CDR2 | DSSNRAT |
| 1006 | 11 | VL CDR3 | QQRYLFPIT |
| 1007 | 11 | VH FR1 | QVQLVQSGAEVKKPGSSVKVSCKASG |
| 1008 | 11 | VH FR2 | WVRQAPGQGLEWMG |
| 1009 | 11 | VH FR3 | RVTITADESTSTAYMELSSLRSEDTAVYYC |
| 1010 | 11 | VH FR4 | WGQGTLVTVSS |
| 1011 | 11 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAACTATGCTATCAGCTGGGTGCGACAGGCCCCTGGACA AGGGCTTGAGTGGATGGGAGGGATCATCCCTATCTTTGGTACA GCAAACTACGCACAGAAGTTCCAGGGCAGAGTCACGATTACC |

| V. Table of Sequences | | | |
|---|---|---|---|
| SEQ ID NO | Clone No | Description | Sequence |
| | | | GCGGACGAATCCACGAGCACAGCCTACATGGAGCTGAGCAGC CTGAGATCTGAGGACACGGCGGTGTACTACTGCGCCAGACCCA GAGGCGACTACAGCGGATACGACGCAGGTCCCATTGACTACTG GGGACAGGGTACATTGGTCACCGTCTCCTCA |
| 1012 | 11 | VH Protein | QVQLVQSGAEVKKPGSSVKVSCKASGGTFSNYAISWVRQAPGQG LEWMGGIIPIFGTANYAQKFQGRVTITADESTSTAYMELSSLRSED TAVYYCARPRGDYSGYDAGPIDYWGQGTLVTVSS |
| 1013 | 11 | VL FR1 | EIVMTQSPATLSLSPGERATLSC |
| 1014 | 11 | VL FR2 | WYQQKPGQAPRLLIY |
| 1015 | 11 | VL FR3 | GIPARFSGSGSGTDFTLTISSLEPEDFAVYYC |
| 1016 | 11 | VL FR4 | FGGGTKVEIK |
| 1017 | 11 | VL DNA | GAAATTGTGATGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATTCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGATACCTCTTCCCTATCACTTTTGGCGGAGG GACCAAGGTTGAGATCAAA |
| 1018 | 11 | VL Protein | EIVMTQSPATLSLSPGERATLSCRASQSVSSYLAWYQQKPGQAPR LLIYDSSNRATGIPARFSGSGSGTDFTLTISSLEPEDFAVYYCQQRY LFPITFGGGTKVEIK |
| 1019-2000 not used | | | |
| 2001 | 12 | VH CDR1 | FTFSSYYMQ |
| 2002 | 12 | VH CDR2 | YISSSSSTIGYADSVKG |
| 2003 | 12 | VH CDR3 | AKGPRYDSSGYRWRYGMDV |
| 2004 | 12 | VL CDR1 | RASQSISSYLN |
| 2005 | 12 | VL CDR2 | AASSLQS |
| 2006 | 12 | VL CDR3 | QQLALTPYT |
| 2007 | 12 | VH FR1 | EVQLVESGGGLVQPGGSLRLSCAASG |
| 2008 | 12 | VH FR2 | WVRQAPGKGLEWVS |
| 2009 | 12 | VH FR3 | RFTISRDNAKNSLYLQMNSLRAEDTAVYYC |
| 2010 | 12 | VH FR4 | WGQGTTVTVSS |
| 2011 | 12 | VH DNA | GAGGTGCAGCTGGTGGAGTCTGGGGGAGGCTTGGTACAGCCTG GGGGGTCCCTGAGACTCTCCTGTGCAGCCTCTGGATTCACCTTC AGTAGCTATTATATGCAGTGGGTCCGCCAGGCTCCAGGGAAGG GGCTGGAGTGGGTTTCATACATTAGTAGTAGTAGTAGTACCAT AGGTTACGCAGACTCTGTGAAGGGCCGATTCACCATCTCCAGA GACAATGCCAAGAACTCACTGTATCTGCAAATGAACAGCCTGA GAGCCGAGGACACGGCGGTGTACTACTGCGCCAAGGGCCCCA GATACGACAGCAGCGGATACCGATGGAGATACGGAATGGACG TATGGGGCCAGGGAACAACTGTCACCGTCTCCTCA |
| 2012 | 12 | VH Protein | EVQLVESGGGLVQPGGSLRLSCAASGFTFSSYYMQWVRQAPGKG LEWVSYISSSSSTIGYADSVKGRFTISRDNAKNSLYLQMNSLRAED TAVYYCAKGPRYDSSGYRWRYGMDVWGQGTTVTVSS |
| 2013 | 12 | VL FR1 | DIQMTQSPSSLSASVGDRVTITC |
| 2014 | 12 | VL FR2 | WYQQKPGKAPKLLIY |
| 2015 | 12 | VL FR3 | GVPSRFSGSGSGTDFTLTISSLQPEDFATYYC |
| 2016 | 12 | VL FR4 | FGGGTKVEIK |

V. Table of Sequences

| SEQ ID NO | Clone No | Description | Sequence |
|---|---|---|---|
| 2017 | 12 | VL DNA | GACATCCAGATGACCCAGTCTCCATCCTCCCTGTCTGCATCTGT AGGAGACAGAGTCACCATCACTTGCCGGGCAAGTCAGAGCATT AGCAGCTATTTAAATTGGTATCAGCAGAAACCAGGGAAAGCCC CTAAGCTCCTGATCTATGCTGCATCCAGTTTGCAAAGTGGGGT CCCATCAAGGTTCAGTGGCAGTGGATCTGGGACAGATTTCACT CTCACCATCAGCAGTCTGCAACCTGAAGATTTTGCAACTTACT ACTGTCAGCAACTAGCCCTCACTCCTTACACTTTTGGCGGAGG GACCAAGGTTGAGATCAAA |
| 2018 | 12 | VL Protein | DIQMTQSPSSLSASVGDRVTITCRASQSISSYLNWYQQKPGKAPKL LIYAASSLQSGVPSRFSGSGSGTDFTLTISSLQPEDFATYYCQQLAL TPYTFGGGTKVEIK |
| 2019-3000 not used | | | |
| 3001 | 13 | VH CDR1 | GTFAEYAIS |
| 3002 | 13 | VH CDR2 | SILPIFGTANYAQKFQG |
| 3003 | 13 | VH CDR3 | AREAGYYRYRYFDL |
| 3004 | 13 | VL CDR1 | RASQSVSSNLA |
| 3005 | 13 | VL CDR2 | GASTRAT |
| 3006 | 13 | VL CDR3 | QQHALWPLT |
| 3007 | 13 | VH FR1 | QVQLVQSGAEVKKPGSSVKVSCKASG |
| 3008 | 13 | VH FR2 | WVRQAPGQGLEWMG |
| 3009 | 13 | VH FR3 | RVTITADESTSTAYMELSSLRSEDTAVYYC |
| 3010 | 13 | VH FR4 | WGRGTLVTVSS |
| 3011 | 13 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCGCTGAGTATGCTATCAGCTGGGTGCGACAGGCCCCTGGACA AGGGCTTGAGTGGATGGGATCTATCCTTCCTATCTTTGGTACAG CAAACTACGCACAGAAGTTCCAGGGCAGAGTCACGATTACCGC GGACGAATCCACGAGCACAGCCTACATGGAGCTGAGCAGCCT GAGATCTGAGGACACGGCGGTGTACTACTGCGCCAGAGAAGC CGGATACTACCGCTACCGATACTTCGACCTATGGGGGAGAGGT ACCTTGGTCACCGTCTCCTCA |
| 3012 | 13 | VH Protein | QVQLVQSGAEVKKPGSSVKVSCKASGGTFAEYAISWVRQAPGQG LEWMGSILPIFGTANYAQKFQGRVTITADESTSTAYMELSSLRSED TAVYYCAREAGYYRYRYFDLWGRGTLVTVSS |
| 3013 | 13 | VL FR1 | EIVMTQSPATLSVSPGERATLSC |
| 3014 | 13 | VL FR2 | WYQQKPGQAPRLLIY |
| 3015 | 13 | VL FR3 | GIPARFSGSGSGTEFTLTISSLQSEDFAVYYC |
| 3016 | 13 | VL FR4 | FGGGTKVEIK |
| 3017 | 13 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT CCCAGGCTCCTCATCTATGGTGCATCCACCAGGGCCACTGGTA TCCCAGCCAGGTTCAGTGGCAGTGGGTCTGGGACAGAGTTCAC TCTCACCATCAGCAGCCTGCAGTCTGAAGATTTTGCAGTTTATT ACTGTCAGCAGCACGCCCTCTGGCCTCTCACTTTTGGCGGAGG GACCAAGGTTGAGATCAAA |

V. Table of Sequences

| SEQ ID NO | Clone No | Description | Sequence |
|---|---|---|---|
| 3018 | 13 | VL Protein | EIVMTQSPATLSVSPGERATLSCRASQSVSSNLAWYQQKPGQAPR LLIYGASTRATGIPARFSGSGSGTEFTLTISSLQSEDFAVYYCQQHA LWPLTFGGGTKVEIK |
| 3019-4000 not used | | | |
| 4001 | 14 | VH CDR1 | GTFASYAIS |
| 4002 | 14 | VH CDR2 | SIIPEFGIANYAQKFQG |
| 4003 | 14 | VH CDR3 | AREAGYYRYRYFDL |
| 4004 | 14 | VL CDR1 | RASQSVSSNLA |
| 4005 | 14 | VL CDR2 | GASTRAT |
| 4006 | 14 | VL CDR3 | QQHALWPLT |
| 4007 | 14 | VH FR1 | QVQLVQSGAEVKKPGSSVKVSCKASG |
| 4008 | 14 | VH FR2 | WVRQAPGQGLEWMG |
| 4009 | 14 | VH FR3 | RVTITADESTSTAYMELSSLRSEDTAVYYC |
| 4010 | 14 | VH FR4 | WGRGTLVTVSS |
| 4011 | 14 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCGCTAGCTATGCTATCAGCTGGGTGCGACAGGCCCCTGGACA AGGGCTTGAGTGGATGGGATCGATCATCCCTGAGTTTGGTATT GCAAACTACGCACAGAAGTTCCAGGGCAGAGTCACGATTACC GCGGACGAATCCACGAGCACAGCCTACATGGAGCTGAGCAGC CTGAGATCTGAGGACACGGCGGTGTACTACTGCGCCAGAGAA GCCGGATACTACCGCTACCGATACTTCGACCTATGGGGGAGAG GTACCTTGGTCACCGTCTCCTCA |
| 4012 | 14 | VH Protein | QVQLVQSGAEVKKPGSSVKVSCKASGGTFASYAISWVRQAPGQG LEWMGSIIPEFGIANYAQKFQGRVTITADESTSTAYMELSSLRSED TAVYYCAREAGYYRYRYFDLWGRGTLVTVSS |
| 4013 | 14 | VL FR1 | EIVMTQSPATLSVSPGERATLSC |
| 4014 | 14 | VL FR2 | WYQQKPGQAPRLLIY |
| 4015 | 14 | VL FR3 | GIPARFSGSGSGTEFTLTISSLQSEDFAVYYC |
| 4016 | 14 | VL FR4 | FGGGTKVEIK |
| 4017 | 14 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT CCCAGGCTCCTCATCTATGGTGCATCCACCAGGGCCACTGGTA TCCCAGCCAGGTTCAGTGGCAGTGGGTCTGGGACAGAGTTCAC TCTCACCATCAGCAGCCTGCAGTCTGAAGATTTTGCAGTTTATT ACTGTCAGCAGCACGCCCTCTGGCCTCTCACTTTTGGCGGAGG GACCAAGGTTGAGATCAAA |
| 4018 | 14 | VL Protein | EIVMTQSPATLSVSPGERATLSCRASQSVSSNLAWYQQKPGQAPR LLIYGASTRATGIPARFSGSGSGTEFTLTISSLQSEDFAVYYCQQHA LWPLTFGGGTKVEIK |
| 4019-5000 not used | | | |
| 5001 | 15 | VH CDR1 | GTFSSYGIS |
| 5002 | 15 | VH CDR2 | SIIPQFGTANYAQKFQG |
| 5003 | 15 | VH CDR3 | AREAGYYRYRYFDL |
| 5004 | 15 | VL CDR1 | RASQSVSSNLA |
| 5005 | 15 | VL CDR2 | GASTRAT |

V. Table of Sequences

| SEQ ID NO | Clone No | Description | Sequence |
|---|---|---|---|
| 5006 | 15 | VL CDR3 | QQHALWPLT |
| 5007 | 15 | VH FR1 | QVQLVQSGAEVKKPGSSVKVSCKASG |
| 5008 | 15 | VH FR2 | WVRQAPGQGLEWMG |
| 5009 | 15 | VH FR3 | RVTITADESTSTVYMELSSLRSEDTAVYYC |
| 5010 | 15 | VH FR4 | WGRGTLVTVSS |
| 5011 | 15 | VH DNA | CAGGTGCAGCTGGTGCAGTCTGGGGCTGAGGTGAAGAAGCCTGGGTCCTCGGTGAAGGTCTCCTGCAAGGCTTCTGGAGGCACCTTCTCGAGCTATGGTATCAGCTGGGTGCGACAGGCCCCTGGACAAGGGCTTGAGTGGATGGGATCGATCATCCCTCAGTTTGGTACAGCAAACTACGCACAGAAGTTCCAGGGCAGAGTCACGATTACCGCGGACGAATCCACGAGCACAGTCTACATGGAGCTGAGCAGCCTGAGATCTGAGGACACGGCGGTGTACTACTGCGCCAGAGAAGCCGGATACTACCGCTACCGATACTTCGACCTATGGGGGAGAGGTACCTTGGTCACCGTCTCCTCA |
| 5012 | 15 | VH Protein | QVQLVQSGAEVKKPGSSVKVSCKASGGTFSSYGISWVRQAPGQGLEWMGSIIPQFGTANYAQKFQGRVTITADESTSTVYMELSSLRSEDTAVYYCAREAGYYRYRYFDLWGRGTLVTVSS |
| 5013 | 15 | VL FR1 | EIVMTQSPATLSVSPGERATLSC |
| 5014 | 15 | VL FR2 | WYQQKPGQAPRLLIY |
| 5015 | 15 | VL FR3 | GIPARFSGSGSGTEFTLTISSLQSEDFAVYYC |
| 5016 | 15 | VL FR4 | FGGGTKVEIK |
| 5017 | 15 | VL DNA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCAACTTAGCCTGGTACCAGCAGAAACCTGGCCAGGCTCCCAGGCTCCTCATCTATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGCACGCCCTCTGGCCTCTCACTTTTGGCGGAGGGACCAAGGTTGAGATCAAA |
| 5018 | 15 | VL Protein | EIVMTQSPATLSVSPGERATLSCRASQSVSSNLAWYQQKPGQAPRLLIYGASTRATGIPARFSGSGSGTEFTLTISSLQSEDFAVYYCQQHALWPLTFGGGTKVEIK |
| 5019-6000 | | not used | |
| 6001 | 16 | VH CDR1 | GTFSSNAIG |
| 6002 | 16 | VH CDR2 | GIIPAFGTANYAQKFQG |
| 6003 | 16 | VH CDR3 | ARDPVRRSPFDI |
| 6004 | 16 | VL CDR1 | RASQSVSSYLA |
| 6005 | 16 | VL CDR2 | DSSNRAT |
| 6006 | 16 | VL CDR3 | QQSFLWPRT |
| 6007 | 16 | VH FR1 | QVQLVQSGAEVKKPGSSVKVSCKASG |
| 6008 | 16 | VH FR2 | WVRQAPGQGLEWMG |
| 6009 | 16 | VH FR3 | RVTITADESTSTAYMELSSLRSEDTAVYYC |
| 6010 | 16 | VH FR4 | WGQGTMVTVSS |
| 6011 | 16 | VH DNA | CAGGTGCAGCTGGTGCAGTCTGGGGCTGAGGTGAAGAAGCCTGGGTCCTCGGTGAAGGTCTCCTGCAAGGCTTCTGGAGGCACCTTCAGCAGCAATGCTATCGGGTGGGTGCGACAGGCCCCTGGACAAGGGCTTGAGTGGATGGGAGGGATCATTCCTGCTTTTGGTACAGCAAACTACGCACAGAAGTTCCAGGGCAGAGTCACGATTACC |

| SEQ ID NO | Clone No | Description | Sequence |
|---|---|---|---|
| | | | GCGGACGAATCCACGAGCACAGCCTACATGGAGCTGAGCAGC<br>CTGAGATCTGAGGACACGGCGGTGTACTACTGCGCCAGAGATC<br>CGGTGAGAAGAAGCCCATTCGACATATGGGGTCAGGGTACAA<br>TGGTCACCGTCTCCTCA |
| 6012 | 16 | VH Protein | QVQLVQSGAEVKKPGSSVKVSCKASGGTFSSNAIGWVRQAPGQG<br>LEWMGGIIPAFGTANYAQKFQGRVTITADESTSTAYMELSSLRSE<br>DTAVYYCARDPVRRSPFDIWGQGTMVTVSS |
| 6013 | 16 | VL FR1 | EIVLTQSPATLSLSPGERATLSC |
| 6014 | 16 | VL FR2 | WYQQKPGQAPRLLIY |
| 6015 | 16 | VL FR3 | GIPARFSGSGSGTDFTLTISSLEPEDFAVYYC |
| 6016 | 16 | VL FR4 | FGGGTKVEIK |
| 6017 | 16 | VL DNA | GAAATTGTGTTGACACAGTCTCCAGCCACCCTGTCTTTGTCTCC<br>AGGGGAAAGAGCCACCCTCTCCTGCAGGGCCAGTCAGAGTGTT<br>AGCAGCTACTTAGCCTGGTACCAACAGAAACCTGGCCAGGCTC<br>CCAGGCTCCTCATCTATGATTCATCCAACAGGGCCACTGGCAT<br>CCCAGCCAGGTTCAGTGGCAGTGGGTCTGGGACAGACTTCACT<br>CTCACCATCAGCAGCCTAGAGCCTGAAGATTTTGCAGTTTATT<br>ACTGTCAGCAGTCCTTCCTCTGGCCTAGGACTTTTGGCGGAGG<br>GACCAAGGTTGAGATCAAA |
| 6018 | 16 | VL Protein | EIVLTQSPATLSLSPGERATLSCRASQSVSSYLAWYQQKPGQAPRL<br>LIYDSSNRATGIPARFSGSGSGTDFTLTISSLEPEDFAVYYCQQSFL<br>WPRTFGGGTKVEIK |
| 6019-7000 not used | | | |
| 7001 | 17 | VH CDR1 | GTFSGYAIH |
| 7002 | 17 | VH CDR2 | GIMPIFGTAAYAQKFQG |
| 7003 | 17 | VH CDR3 | ARPRGDYSGYDAGPIDY |
| 7004 | 17 | VL CDR1 | RASQSVSSYLA |
| 7005 | 17 | VL CDR2 | DASNRAT |
| 7006 | 17 | VL CDR3 | QQRFHFPPT |
| 7007 | 17 | VH FR1 | QVQLVQSGAEVKKPGSSVKVSCKASG |
| 7008 | 17 | VH FR2 | WVRQAPGQGLEWMG |
| 7009 | 17 | VH FR3 | RVTITADESTSTAYMELSSLRSEDTAVYYC |
| 7010 | 17 | VH FR4 | WGQGTLVTVSS |
| 7011 | 17 | VH DNA | CAGGTGCAGCTGGTGCAGTCTGGGGCTGAGGTGAAGAAGCCT<br>GGGTCCTCGGTGAAGGTCTCCTGCAAGGCTTCTGGAGGCACCT<br>TCAGCGGGTATGCTATCCATTGGGTGCGACAGGCCCCTGGACA<br>AGGGCTTGAGTGGATGGGAGGGATCATGCCTATCTTTGGTACA<br>GCAGCGTACGCACAGAAGTTCCAGGGCAGAGTCACGATTACC<br>GCGGACGAATCCACGAGCACAGCCTACATGGAGCTGAGCAGC<br>CTGAGATCTGAGGACACGGCGGTGTACTACTGCGCCAGACCCA<br>GAGGCGACTACAGCGGATACGACGCAGGTCCCATTGACTACTG<br>GGGACAGGGTACATTGGTCACCGTCTCCTCA |
| 7012 | 17 | VH Protein | QVQLVQSGAEVKKPGSSVKVSCKASGGTFSGYAIHWVRQAPGQG<br>LEWMGGIMPIFGTAAYAQKFQGRVTITADESTSTAYMELSSLRSE<br>DTAVYYCARPRGDYSGYDAGPIDYWGQGTLVTVSS |
| 7013 | 17 | VL FR1 | EIVLTQSPATLSLSPGERATLSC |
| 7014 | 17 | VL FR2 | WYQQKPGQAPRLLIY |
| 7015 | 17 | VL FR3 | GIPARFSGSGSGTDFTLTISSLEPEDFAVYYC |
| 7016 | 17 | VL FR4 | FGGGTKVEIK |

V. Table of Sequences

| SEQ ID NO | Clone No | Description | Sequence |
|---|---|---|---|
| 7017 | 17 | VL DNA | GAAATTGTGTTGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATGCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGATTCCACTTCCCTCCTACTTTTGGCGGAGG GACCAAGGTTGAGATCAAA |
| 7018 | 17 | VL Protein | EIVLTQSPATLSLSPGERATLSCRASQSVSSYLAWYQQKPGQAPRL LIYDASNRATGIPARFSGSGSGTDFTLTISSLEPEDFAVYYCQQRFH FPPTFGGGTKVEIK |
| 7019-8000 not used | | | |
| 8001 | 18 | VH CDR1 | GSISSGGSYWS |
| 8002 | 18 | VH CDR2 | AIYYDGSTYYNPSLKS |
| 8003 | 18 | VH CDR3 | ARGSPTYHDFDL |
| 8004 | 18 | VL CDR1 | RASQSVSSYLA |
| 8005 | 18 | VL CDR2 | DASNRAT |
| 8006 | 18 | VL CDR3 | QQRAIWPPT |
| 8007 | 18 | VH FR1 | QVQLQESGPGLVKPSQTLSLTCTVSG |
| 8008 | 18 | VH FR2 | WIRQHPGKGLEWIG |
| 8009 | 18 | VH FR3 | RVTISVDTSKNQFSLKLSSVTAADTAVYYC |
| 8010 | 18 | VH FR4 | WGRGTLVTVSS |
| 8011 | 18 | VH DNA | CAGGTGCAGCTGCAGGAGTCGGGCCCAGGACTGGTGAAGCCTT CACAGACCCTGTCCCTCACCTGTACTGTCTCTGGTGGCTCCATC AGCAGTGGTGGTTCTTACTGGTCTTGGATCCGCCAGCACCCAG GGAAGGGCCTGGAGTGGATTGGGGCGATCTATTACGATGGGA GCACCTACTACAACCCGTCCCTCAAGAGTCGAGTTACCATATC AGTAGACACGTCTAAGAACCAGTTCTCCCTGAAGCTGAGTTCT GTGACCGCCGCAGACACGGCGGTGTACTACTGCGCCAGAGGTT CCCCTACATACCACGACTTCGACCTATGGGGAGAGGTACCTT GGTCACCGTCTCCTCA |
| 8012 | 18 | VH Protein | QVQLQESGPGLVKPSQTLSLTCTVSGGSISSGGSYWSWIRQHPGK GLEWIGAIYYDGSTYYNPSLKSRVTISVDTSKNQFSLKLSSVTAAD TAVYYCARGSPTYHDFDLWGRGTLVTVSS |
| 8013 | 18 | VL FR1 | EIVLTQSPATLSLSPGERATLSC |
| 8014 | 18 | VL FR2 | WYQQKPGQAPRLLIY |
| 4015 | 18 | VL FR3 | GIPARFSGSGSGTDFTLTISSLEPEDFAVYYC |
| 8016 | 18 | VL FR4 | FGGGTKVEIK |
| 8017 | 18 | VL DNA | GAAATTGTGTTGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATGCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGAGCCATCTGGCCTCCTACTTTTGGCGGAGG GACCAAGGTTGAGATCAAA |

V. Table of Sequences

| SEQ ID NO | Clone No | Description | Sequence |
|---|---|---|---|
| 8018 | 18 | VL Protein | EIVLTQSPATLSLSPGERATLSCRASQSVSSYLAWYQQKPGQAPRLLIYDASNRATGIPARFSGSGSGTDFTLTISSLEPEDFAVYYCQQRAIWPPTFGGGTKVEIK |
| 8019-9000 not used | | | |
| 9001 | 19 | VH CDR1 | FTFRSYWMS |
| 9002 | 19 | VH CDR2 | TIKQDGSEKFYVDSVKG |
| 9003 | 19 | VH CDR3 | ARDFTRWSHVNWFDP |
| 9004 | 19 | VL CDR1 | RASQSVSSSLA |
| 9005 | 19 | VL CDR2 | GASTRAT |
| 9006 | 19 | VL CDR3 | QQYYHHPYT |
| 9007 | 19 | VH FR1 | EVQLVESGGGLVQPGGSLRLSCAASG |
| 9008 | 19 | VH FR2 | WVRQAPGKGLEWVA |
| 9009 | 19 | VH FR3 | RFTISRDNAKNSLYLQMNSLRAEDTAVYYC |
| 9010 | 19 | VH FR4 | WGQGTLVTVSS |
| 9011 | 19 | VH DNA | GAGGTGCAGCTGGTGGAGTCTGGGGGAGGCTTGGTCCAGCCTGGGGGGTCCCTGAGACTCTCCTGTGCAGCCTCTGGATTCACCTTTCGTAGCTATTGGATGAGCTGGGTCCGCCAGGCTCCAGGGAAGGGGCTGGAGTGGGTGGCCACGATAAAGCAAGATGGAAGTGAGAAATTTTATGTGGACTCTGTGAAGGGCCGATTCACCATCTCCAGAGACAACGCCAAGAACTCACTGTATCTGCAAATGAACAGCCTGAGAGCCGAGGACACGGCGGTGTACTACTGCGCTAGGGATTTCACTAGATGGTCCCACGTGAACTGGTTTGATCCCTGGGGACAGGGTACATTGGTCACCGTCTCCTCA |
| 9012 | 19 | VH Protein | EVQLVESGGGLVQPGGSLRLSCAASGFTFRSYWMSWVRQAPGKGLEWVATIKQDGSEKFYVDSVKGRFTISRDNAKNSLYLQMNSLRAEDTAVYYCARDFTRWSHVNWFDPWGQGTLVTVSS |
| 9013 | 19 | VL FR1 | EIVMTQSPATLSVSPGERATLSC |
| 9014 | 19 | VL FR2 | WYQQKPGQAPRLLIF |
| 9015 | 19 | VL FR3 | GIPARFSGSGSGTEFTLTISSLQSEDFAVYYC |
| 9016 | 19 | VL FR4 | FGGGTKVEIK |
| 9017 | 19 | VL DNA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCAGCTTAGCCTGGTACCAGCAGAAACCTGGCCAGGCTCCCAGGCTCCTCATCTTTGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTACTACCACCACCCTTACACTTTTGGCGGAGGGACCAAGGTTGAGATCAAA |
| 9018 | 19 | VL Protein | EIVMTQSPATLSVSPGERATLSCRASQSVSSSLAWYQQKPGQAPRLLIFGASTRATGIPARFSGSGSGTEFTLTISSLQSEDFAVYYCQQYYHHPYTFGGGTKVEIK |
| 9019-10000 not used | | | |
| 10001 | 20 | VH CDR1 | GTFSSYAIS |
| 10002 | 20 | VH CDR2 | GILPIFGDANYAQKFQG |
| 10003 | 20 | VH CDR3 | ARPRGDYSGYDAGPIDY |
| 10004 | 20 | VL CDR1 | RASQSVSSYLA |
| 10005 | 20 | VL CDR2 | DSSNRAT |

| | | V. Table of Sequences | |
|---|---|---|---|
| SEQ ID NO | Clone No | Description | Sequence |
| 10006 | 20 | VL CDR3 | QQRYLFPIT |
| 10007 | 20 | VH FR1 | QVQLVQSGAEVKKPGSSVKVSCKASG |
| 10008 | 20 | VH FR2 | WVRQAPGQGLEWMG |
| 10009 | 20 | VH FR3 | RVTITADESTSTAYMELSSLRSEDTAVYYC |
| 10010 | 20 | VH FR4 | WGQGTLVTVSS |
| 10011 | 20 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAGCTATGCTATCAGCTGGGTGCGACAGGCCCCTGGACA AGGGCTTGAGTGGATGGGAGGGATCTTGCCTATCTTTGGTGAT GCAAACTACGCACAGAAGTTCCAGGGCAGAGTCACGATTACC GCGGACGAATCCACGAGCACAGCCTACATGGAGCTGAGCAGC CTGAGATCTGAGGACACGGCGGTGTACTACTGCGCCAGACCCA GAGGCGACTACAGCGGATACGACGCAGGTCCCATTGACTACTG GGGACAGGGTACATTGGTCACCGTCTCCTCA |
| 10012 | 20 | VH Protein | QVQLVQSGAEVKKPGSSVKVSCKASGGTFSSYAISWVRQAPGQG LEWMGGILPIFGDANYAQKFQGRVTITADESTSTAYMELSSLRSE DTAVYYCARPRGDYSGYDAGPIDYWGQGTLVTVSS |
| 10013 | 20 | VL FR1 | EIVMTQSPATLSLSPGERATLSC |
| 10014 | 20 | VL FR2 | WYQQKPGQAPRLLIY |
| 10015 | 20 | VL FR3 | GIPARFSGSGSGTDFTLTISSLEPEDFAVYYC |
| 10016 | 20 | VL FR4 | FGGGTKVEIK |
| 10017 | 20 | VL DNA | GAAATTGTGATGACACAGTCTCCAGCCACCCTGTCTTTGTCTCC AGGGGAAAGAGCCACCCTCTCCTGCAGGGCCAGTCAGAGTGTT AGCAGCTACTTAGCCTGGTACCAACAGAAACCTGGCCAGGCTC CCAGGCTCCTCATCTATGATTCATCCAACAGGGCCACTGGCAT CCCAGCCAGGTTCAGTGGCAGTGGGTCTGGGACAGACTTCACT CTCACCATCAGCAGCCTAGAGCCTGAAGATTTTGCAGTTTATT ACTGTCAGCAGAGATACCTCTTCCCTATCACTTTTGGCGGAGG GACCAAGGTTGAGATCAAA |
| 10018 | 20 | VL Protein | EIVMTQSPATLSLSPGERATLSCRASQSVSSYLAWYQQKPGQAPR LLIYDSSNRATGIPARFSGSGSGTDFTLTISSLEPEDFAVYYCQQRY LFPITFGGGTKVEIK |
| 10019-20000 | | not used | |
| 20001 | 21 | VH CDR1 | GTFSSEGIS |
| 20002 | 21 | VH CDR2 | SILPIFGTANYAQKFQG |
| 20003 | 21 | VH CDR3 | AREAGYYRYRYFDL |
| 20004 | 21 | VL CDR1 | RASQSVSSNLA |
| 20005 | 21 | VL CDR2 | GASTRAT |
| 20006 | 21 | VL CDR3 | QQHALWPLT |
| 20007 | 21 | VH FR1 | QVQLVQSGAEVKKPGSSVKVSCKASG |
| 20008 | 21 | VH FR2 | WVRQAPGQGLEWMG |
| 20009 | 21 | VH FR3 | RVTITADESTSTAYMELSSLRSEDTAVYYC |
| 20010 | 21 | VH FR4 | WGKGTLVTVSS |
| 20011 | 21 | VH DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAGCGAGGGTATCAGCTGGGTGCGACAGGCCCCTGGAC AAGGGCTTGAGTGGATGGGAAGTATCTTGCCTATCTTTGGTAC AGCAAACTACGCACAGAAGTTCCAGGGCAGAGTCACGATTAC |

V. Table of Sequences

| SEQ ID NO | Clone No | Description | Sequence |
|---|---|---|---|
| | | | CGCGGACGAATCCACGAGCACAGCCTACATGGAGCTGAGCAG CCTGAGATCTGAGGACACGGCGGTGTACTACTGCGCCAGAGAA GCCGGATACTACCGCTACCGATACTTCGACCTATGGGGAAAG GTACCTTGGTCACCGTCTCCTCA |
| 20012 | 21 | VH Protein | QVQLVQSGAEVKKPGSSVKVSCKASGGTFSSEGISWVRQAPGQG LEWMGSILPIFGTANYAQKFQGRVTITADESTSTAYMELSSLRSED TAVYYCAREAGYYRYRYFDLWGKGTLVTVSS |
| 20013 | 21 | VL FR1 | EIVMTQSPATLSVSPGERATLSC |
| 20014 | 21 | VL FR2 | WYQQKPGQAPRLLIY |
| 20015 | 21 | VL FR3 | GIPARFSGSGSGTEFTLTISSLQSEDFAVYYC |
| 20016 | 21 | VL FR4 | FGGGTKVEIK |
| 20017 | 21 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT CCCAGGCTCCTCATCTATGGTGCATCCACCAGGGCCACTGGTA TCCCAGCCAGGTTCAGTGGCAGTGGGTCTGGGACAGAGTTCAC TCTCACCATCAGCAGCCTGCAGTCTGAAGATTTTGCAGTTTATT ACTGTCAGCAGCACGCCCTCTGGCCTCTCACTTTTGGCGGAGG GACCAAGGTTGAGATCAAA |
| 20018 | 21 | VL Protein | EIVMTQSPATLSVSPGERATLSCRASQSVSSNLAWYQQKPGQAPR LLIYGASTRATGIPARFSGSGSGTEFTLTISSLQSEDFAVYYCQQHA LWPLTFGGGTKVEIK |
| 20019 | 21 | Heavy Chain Protein | QVQLVQSGAEVKKPGSSVKVSCKASGGTFSSEGISWVRQAPGQG LEWMGSILPIFGTANYAQKFQGRVTITADESTSTAYMELSSLRSED TAVYYCAREAGYYRYRYFDLWGKGTLVTVSSASTKGPSVFPLAP CSRSTSESTAALGCLVKDYFPEPVTVSWNSGALTSGVHTFPAVLQ SSGLYSLSSVVTVPSSSLGTKTYTCNVDHKPSNTKVDKRVESKYG PPCPPCPAPEFLGGPSVFLFPPKPKDTLMISRTPEVTCVVVDVSQE DPEVQFNWYVDGVEVHNAKTKPREEQFNSTYRVVSVLTVLHQD WLNGKEYKCKVSNKGLPSSIEKTISKAKGQPREPQVYTLPPSQEE MTKNQVSLTCLVKGFYPSDIAVEWESNGQPENNYKTTPPVLDSD GSFFLYSRLTVDKSRWQEGNVFSCSVMHEALHNHYTQKSLSLSL G |
| 20020 | 21 | Heavy Chain DNA | CAGGTGCAGCTGGTGCAGTCTGGGGCTGAGGTGAAGAAGCCT GGGTCCTCGGTGAAGGTCTCCTGCAAGGCTTCTGGAGGCACCT TCAGCAGCGAGGGTATCAGCTGGGTGCGACAGGCCCCTGGAC AAGGGCTTGAGTGGATGGGAAGTATCTTGCCTATCTTTGGTAC AGCAAACTACGCACAGAAGTTCCAGGGCAGAGTCACGATTAC CGCGGACGAATCCACGAGCACAGCCTACATGGAGCTGAGCAG CCTGAGATCTGAGGACACGGCGGTGTACTACTGCGCCAGAGAA GCCGGATACTACCGCTACCGATACTTCGACCTATGGGGAAAG GTACCTTGGTCACCGTCTCCTCAGCTTCCACCAAGGGCCCCTCC GTGTTCCCTCTGGCCCCTTGCTCCCGGTCCACCTCCGAGTCTAC CGCCGCTCTGGGCTGCCTCGTGAAGGACTACTTCCCCGAGCCC GTGACCGTGTCCTGGAACTCTGGCGCCCTGACCTCCGGCGTGC ACACCTTCCCTGCCGTGCTGCAGTCCTCCGGCCTGTACTCCCTG TCCAGCGTCGTGACCGTGCCCTCCTCCAGCCTGGGCACCAAGA CCTACACCTGTAACGTGGACCACAAGCCCTCCAACACCAAAGT GGACAAGCGGGTGGAATCTAAGTACGGCCCTCCCTGCCCTCCT TGCCCTGCCCCTGAGTTCCTGGGCGGACCTTCCGTGTTCCTGTT CCCTCCAAAGCCCAAGGACACCCTGATGATCTCCCGGACCCCT GAAGTGACCTGCGTGGTGGTGGACGTGTCCCAGGAAGATCCCG AAGTCCAGTTCAATTGGTACGTGGACGGCGTGGAAGTGCACAA CGCCAAGACCAAGCCCAGAGAGGAACAGTTCAACTCCACCTA CCGGGTGGTGTCCGTGCTGACCGTGCTGCACCAGGACTGGCTG AACGGCAAAGAGTACAAGTGCAAAGTGTCCAACAAGGGCCTG CCCTCCAGCATCGAAAAGACCATCTCCAAGGCCAAGGGCCAGC CCCGCGAGCCCCAAGTGTACACCCTGCCTCCCAGCCAGGAAGA GATGACCAAGAATCAAGTGTCCCTGACTTGTCTGGTCAAGGGC TTCTACCCCTCCGATATCGCCGTGGAGTGGGAGTCCAACGGCC AGCCCGAGAACAACTACAAGACCACCCCTCCCGTGCTGGACTC CGACGGCTCCTTCTTCCTGTACTCTCGGCTGACCGTGGACAAGT |

V. Table of Sequences

| SEQ ID NO | Clone No | Description | Sequence |
|---|---|---|---|
| | | | CCCGGTGGCAGGAAGGCAACGTCTTCTCCTGCTCCGTGATGCA CGAGGCCCTGCACAACCACTACACCCAGAAGTCCCTGTCCCTG TCTCTGGGC |
| 20021 | 21 | Light Chain Protein | EIVMTQSPATLSVSPGERATLSCRASQSVSSNLAWYQQKPGQAPR LLIYGASTRATGIPARFSGSGSGTEFTLTISSLQSEDFAVYYCQQHA LWPLTFGGGTKVEIKRTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC |
| 20022 | 21 | Light Chain DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT CCCAGGCTCCTCATCTATGGTGCATCCACCAGGGCACTGGTA TCCCAGCCAGGTTCAGTGGCAGTGGGTCTGGGACAGAGTTCAC TCTCACCATCAGCAGCCTGCAGTCTGAAGATTTTGCAGTTTATT ACTGTCAGCAGCACGCCCTCTGGCCTCTCACTTTTGGCGGAGG GACCAAGGTTGAGATCAAACGTACGGTGGCCGCTCCCTCCGTG TTCATCTTCCCACCCTCCGACGAGCAGCTGAAGTCCGGCACCG CCTCCGTCGTGTGCCTGCTGAACAACTTCTACCCTCGCGAGGCC AAAGTGCAGTGGAAAGTGGACAACGCCCTGCAGTCCGGCAAC TCCCAGGAATCCGTCACCGAGCAGGACTCCAAGGACAGCACCT ACTCCCTGTCCTCCACCCTGACCCTGTCCAAGGCCGACTACGA GAAGCACAAGTGTACGCCTGCGAAGTGACCCACCAGGGCCT GTCCAGCCCCGTGACCAAGTCCTTCAACCGGGGCGAGTGC |
| 20023-30000 | | not used | |
| 30001 | 22 | VH CDR1 | GTFSSEGIS |
| 30002 | 22 | VH CDR2 | SILPIFGTANYAQKFQG |
| 30003 | 22 | VH CDR3 | AREAGYYRYRYFDL |
| 30004 | 22 | VL CDR1 | RASQSVSSNLA |
| 30005 | 22 | VL CDR2 | GASTRAT |
| 30006 | 22 | VL CDR3 | QQHALWPLT |
| 30007 | 22 | VH FR1 | QVQLVQSGAEVKKPGSSVKVSCKASG |
| 30008 | 22 | VH FR2 | WVRQAPGQGLEWMG |
| 30009 | 22 | VH FR3 | RVTITADESTSTAYMELSSLRSEDTAVYYC |
| 30010 | 22 | VH FR4 | WGRGTLVTVSS |
| 30011 | 22 | VH DNA | CAAGTGCAGTTGGTGCAGTCCGGAGCCGAAGTCAAGAAGCCC GGGTCGAGCGTGAAAGTGTCCTGCAAGGCTTCTGGTGGAACCT TCTCAAGCGAAGGGATCAGCTGGGTCAGACAGGCGCCGGGCC AGGGTCTGGAGTGGATGGGTTCCATTCTCCCGATCTTCGGAAC CGCCAATTACGCCCAGAAGTTCCAGGGTCGCGTGACCATCACC GCCGACGAAAGCACCTCGACGGCCTATATGGAATTGTCGTCCC TGCGGTCGGAAGATACAGCGGTGTACTACTGTGCGCGGGAAGC CGGGTACTACCGCTACCGCTACTTCGATCTGTGGGGAAGGGGA ACTCTCGTGACTGTGTCGAGCG |
| 30012 | 22 | VH Protein | QVQLVQSGAEVKKPGSSVKVSCKASGGTFSSEGISWVRQAPGQG LEWMGSILPIFGTANYAQKFQGRVTITADESTSTAYMELSSLRSED TAVYYCAREAGYYRYRYFDLWGRGTLVTVSS |
| 30013 | 22 | VL FR1 | EIVMTQSPATLSVSPGERATLSC |
| 30014 | 22 | VL FR2 | WYQQKPGQAPRLLIY |
| 30015 | 22 | VL FR3 | GIPARFSGSGSGTEFTLTISSLQSEDFAVYYC |
| 30016 | 22 | VL FR4 | FGGGTKVEIK |
| 30017 | 22 | VL DNA | GAAATAGTGATGACGCAGTCTCCAGCCACCCTGTCTGTGTCTC CAGGGGAAAGAGCCACCCTCTCCTGCAGGGCCAGTCAGAGTGT TAGCAGCAACTTAGCCTGGTACCAGCAGAAACCTGGCCAGGCT |

V. Table of Sequences

| SEQ ID NO | Clone No | Description | Sequence |
|---|---|---|---|
| | | | CCCAGGCTCCTCATCTATGGTGCATCCACCAGGGCCACTGGTA<br>TCCCAGCCAGGTTCAGTGGCAGTGGGTCTGGGACAGAGTTCAC<br>TCTCACCATCAGCAGCCTGCAGTCTGAAGATTTTGCAGTTTATT<br>ACTGTCAGCAGCACGCCCTCTGGCCTCTCACTTTTGGCGGAGG<br>GACCAAGGTTGAGATCAAA |
| 30018 | 22 | VL Protein | EIVMTQSPATLSVSPGERATLSCRASQSVSSNLAWYQQKPGQAPR<br>LLIYGASTRATGIPARFSGSGSGTEFTLTISSLQSEDFAVYYCQQHA<br>LWPLTFGGGTKVEIK |
| 30019 | 22 | Heavy Chain Protein | QVQLVQSGAEVKKPGSSVKVSCKASGGTFSSEGISWVRQAPGQG<br>LEWMGSILPIFGTANYAQKFQGRVTITADESTSTAYMELSSLRSED<br>TAVYYCAREAGYYRYRYFDLWGRGTLVTVSSASTKGPSVFPLAP<br>CSRSTSESTAALGCLVKDYFPEPVTVSWNSGALTSGVHTFPAVLQ<br>SSGLYSLSSVVTVPSSSLGTKTYTCNVDHKPSNTKVDKRVESKYG<br>PPCPPCPAPEFLGGPSVFLFPPKPKDTLMISRTPEVTCVVVDVSQE<br>DPEVQFNWYVDGVEVHNAKTKPREEQFNSTYRVVSVLTVLHQD<br>WLNGKEYKCKVSNKGLPSSIEKTISKAKGQPREPQVYTLPPSQEE<br>MTKNQVSLTCLVKGFYPSDIAVEWESNGQPENNYKTTPPVLDSD<br>GSFFLYSRLTVDKSRWQEGNVFSCSVMHEALHNHYTQKSLSLSL<br>G |
| 30020 | 22 | Heavy Chain DNA | CAAGTGCAGTTGGTGCAGTCCGGAGCCGAAGTCAAGAAGCCC<br>GGGTCGAGCGTGAAAGTGTCCTGCAAGGCTTCTGGTGAACCT<br>TCTCAAGCGAAGGGATCAGCTGGGTCAGACAGGCGCCGGGCC<br>AGGGTCTGGAGTGGATGGGTTCCATTCTCCCGATCTTCGGAAC<br>CGCCAATTACGCCCAGAAGTTCCAGGGTCGCGTGACCATCACC<br>GCCGACGAAAGCACCTCGACGGCCTATATGGAATTGTCGTCCC<br>TGCGGTCGGAAGATACAGCGGTGTACTACTGTGCGCGGGAAGC<br>CGGGTACTACCGCTACCGCTACTTCGATCTGTGGGGAAGGGGA<br>ACTCTCGTGACTGTGTCGAGCGCCAGCACCAAGGGACCCAGCG<br>TGTTCCCGCTGGCCCCTTGTTCACGATCCACTTCCGAAAGCACC<br>GCTGCCCTTGGCTGCCTTGTCAAGGACTACTTCCCTGAGCCCGT<br>CACTGTGTCGTGGAACAGCGGAGCTCTGACCTCCGGCGTCCAC<br>ACCTTCCCGGCTGTGCTCCAGTCCTCCGGCCTGTACTCACTGTC<br>CTCGGTGGTCACCGTGCCCTCCTCCTCCCTGGTACCAAGACTT<br>ATACCTGCAACGTGGACCACAAGCCCTCCAACACCAAAGTGGA<br>TAAGAGAGTGGAGAGCAAATACGGACCTCCCTGCCCT<u>CCTTGC</u><br>CCTGCGCCTGAGTTTCTGGGCGGACCATCCGTCTTTCTGTTCCC<br>ACCGAAGCCCAAGGACACCCTCATGATCTCCCGGACCCCCGAA<br>GTGACCTGTGTGGTGGTGGACGTGTCACAGGAGGACCCTGAAG<br>TGCAGTTTAATTGGTACGTCGACGGCGTGGAAGTGCATAACGC<br>AAAGACCAAGCCGCGGGAGGAACAGTTCAACTCAACCTACCG<br>CGTGGTGTCCGTGCTGACTGTGCTGCACCAGGACTGGCTGAAC<br>GGAAAGGAGTATAAGTGCAAAGTCTCCAACAAGGGACTGCCG<br>AGCAGCATCGAGAAAACCATTTCAAAAGCCAAGGGCCAGCCG<br>AGAGAGCCCCAAGTGTACACTCTGCCGCCGAGCCAAGAGGAA<br>ATGACCAAGAACCAAGTGTCCCTCACTTGCCTGGTCAAGGGCT<br>TCTACCCGTCGGACATCGCCGTGGAGTGGGAAAGCAACGGCCA<br>GCCGGAAAACAACTACAAGACTACCCCTCCCGTCCTCGACTCC<br>GACGGGTCCTTCTTCCTCTACTCCCGGCTGACTGTGGATAAGTC<br>ACGGTGGCAGGAGGGAAACGTGTTCTCGTGCTCCGTGATGCAC<br>GAAGCCCTGCACAACCACTACACGCAGAAGTCCCT<u>GTCCTTGT</u><br><u>CCCTGGGG</u> |
| 30021 | 22 | Light Chain Protein | EIVMTQSPATLSVSPGERATLSCRASQSVSSNLAWYQQKPGQAPR<br>LLIYGASTRATGIPARFSGSGSGTEFTLTISSLQSEDFAVYYCQQHA<br>LWPLTFGGGTKVEIKRTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC |
| 30022 | 22 | Light Chain DNA | GAAATAGTGATGACGCAGTCTCCAGCCACCCTGTCTGTGTCTC<br>CAGGGGAAAGAGCCACCCTCTCCTGCAGGGCCAGTCAGAGTGT<br>TAGCAGCAACTTAGCCTGGTACCAGCAGAAACCTGGCCAGGCT<br>CCCAGGCTCCTCATCTATGGTGCATCCACCAGGGCCACTGGTA<br>TCCCAGCCAGGTTCAGTGGCAGTGGGTCTGGGACAGAGTTCAC<br>TCTCACCATCAGCAGCCTGCAGTCTGAAGATTTTGCAGTTTATT<br>ACTGTCAGCAGCACGCCCTCTGGCCTCTCACTTTTGGCGGAGG<br>GACCAAGGTTGAGATCAAACGTACGGTGGCCGCTCCCTCCGTG<br>TTCATCTTCCCACCCTCCGACGAGCAGCTGAAGTCCGGCACCG<br>CCTCCGTCGTGTGCCTGCTGAACAACTTCTACCCTCGCGAGGCC<br>AAAGTGCAGTGGAAGTGGACAACGCCCTGCAGTCCGGCAAC<br>TCCCAGGAATCCGTCACCGAGCAGGACTCCAAGGACAGCACCT |

V. Table of Sequences

| SEQ ID NO | Clone No | Description | Sequence |
|---|---|---|---|
| | | | ACTCCCTGTCCTCCACCCTGACCCTGTCCAAGGCCGACTACGA GAAGCACAAAGTGTACGCCTGCGAAGTGACCCACCAGGGCCT GTCCAGCCCCGTGACCAAGTCCTTCAACCGGGGCGAGTGC |
| 30023 | 22 | Heavy Chain DNA (5' and 3' EcoRV restriction sites (bold), Kozak sequence (italics); signal sequence (underline)) | GATATC*GCCA*<u>CC</u>ATGGCCTCTCCAGCTCAGCTGCTGTTTC TGCTGCTGCTGTGGCTGCCTGACGGCGTGCACGCACAAGTGCA GTTGGTGCAGTCCGGAGCCGAAGTCAAGAAGCCCGGGTCGAG CGTGAAAGTGTCCTGCAAGGCTTCTGGTGGAACCTTCTCAAGC GAAGGGATCAGCTGGGTCAGACAGGCGCCGGGCCAGGGTCTG GAGTGGATGGGTTCCATTCTCCCGATCTTCGGAACCGCCAATT ACGCCCAGAAGTTCCAGGGTCGCGTGACCATCACCGCCGACGA AAGCACCTCGACGGCCTATATGGAATTGTCGTCCCTGCGGTCG GAAGATACAGCGGTGTACTACTGTGCGCGGGAAGCCGGGTACT ACCGCTACCGCTACTTCGATCTGTGGGGAAGGGGAACTCTCGT GACTGTGTCGAGCGCCAGCACCAAGGGACCCAGCGTGTTCCCG CTGGCCCCTTGTTCACGATCCACTTCCGAAAGCACCGCTGCCCT TGGCTGCCTTGTCAAGGACTACTTCCCTGAGCCCGTCACTGTGT CGTGGAACAGCGGAGCTCTGACCTCCGGCGTCCACACCTTCCC GGCTGTGCTCCAGTCCTCCGGCCTGTACTCACTGTCCTCGGTGG TCACCGTGCCCTCCTCCTCCCTCGGTACCAAGACTTATACCTGC AACGTGGACCACAAGCCCTCCAACACCAAAGTGGATAAGAGA GTGGAGAGCAAATACGGACCTCCCTGCCCT<u>CCTT</u>GCCCTGCGC CTGAGTTTCTGGGCGGACCATCCGTCTTTCTGTTCCCACCGAAG CCCAAGGACACCCTCATGATCTCCCGGACCCCCGAAGTGACCT GTGTGGTGGTGGACGTGTCACAGGAGGACCCTGAAGTGCAGTT TAATTGGTACGTCGACGGCGTGGAAGTGCATAACGCAAAGACC AAGCCGCGGGAGGAACAGTTCAACTCAACCTACCGCGTGGTGT CCGTGCTGACTGTGCTGCACCAGGACTGGCTGAACGGAAAGGA GTATAAGTGCAAAGTCTCCAACAAGGGACTGCCGAGCAGCATC GAGAAAACCATTTCAAAAGCCAAGGGCCAGCCGAGAGAGCCC CAAGTGTACACTCTGCCGCCGAGCCAAGAGGAAATGACCAAG AACCAAGTGTCCCTCACTTGCCTGGTCAAGGGCTTCTACCCGTC GGACATCGCCGTGGAGTGGGAAAGCAACGGCCAGCCGGAAAA CAACTACAAGACTACCCCTCCCGTCCTCGACTCCGACGGGTCC TTCTTCCTCTACTCCCGGCTGACTGTGGATAAGTCACGGTGGCA GGAGGGAAACGTGTTCTCGTGCTCCGTGATGCACGAAGCCCTG CACAACCACTACACGCAGAAGTCCCTGTCCTTGTCCCTGGGGA AGTAATGAGATATC |

30023-39999 not used

| 40000 | | Human IgG1 Constant Region | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKKVEPKSCDKTHTCPPCPAPELLGGPSVFLFPPKPKDTLMIS RTPEVTCVVVDVSHEDPEVKFNWYVDGVEVHNAKTKPREEQYN STYRVVSVLTVLHQDWLNGKEYKCKVSNKALPAPIEKTISKAKG QPREPQVYTLPPSRDELTKNQVSLTCLVKGFYPSDIAVEWESNGQ PENNYKTTPPVLDSDGSFFLYSKLTVDKSRWQQGNVFSCSVMHE ALHNHYTQKSLSLSPGK |
| 40001 | | Human IgG4 Constant Region (terminal K absent)* | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPSCPAPEFLGGPSVFLFPPKPKDTLMISRTPE VTCVVVDVSQEDPEVQFNWYVDGVEVHNAKTKPREEQFNSTYR VVSVLTVLHQDWLNGKEYKCKVSNKGLPSSIEKTISKAKGQPREP QVYTLPPSQEEMTKNQVSLTCLVKGFYPSDIAVEWESNGQPENN YKTTPPVLDSDGSFFLYSRLTVDKSRWQEGNVFSCSVMHEALHN HYTQKSLSLSLG- |
| 40002 | | Human IgG4 Constant Region (S228P; bolded) (terminal K absent)* | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPPCPAPEFLGGPSVFLFPPKPKDTLMISRTPE VTCVVVDVSQEDPEVQFNWYVDGVEVHNAKTKPREEQFNSTYR VVSVLTVLHQDWLNGKEYKCKVSNKGLPSSIEKTISKAKGQPREP QVYTLPPSQEEMTKNQVSLTCLVKGFYPSDIAVEWESNGQPENN YKTTPPVLDSDGSFFLYSRLTVDKSRWQEGNVFSCSVMHEALHN HYTQKSLSLSLG- |

V. Table of Sequences

| SEQ ID NO | Clone No | Description | Sequence |
|---|---|---|---|
| 40003 | | Human IgG4 Constant Region (S228P) (L235E) (terminal K absent)* | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPPCPAPEFEGGPSVFLFPPKPKDTLMISRTPE VTCVVVDVSQEDPEVQFNWYVDGVEVHNAKTKPREEQFNSTYR VVSVLTVLHQDWLNGKEYKCKVSNKGLPSSIEKTISKAKGQPREP QVYTLPPSQEEMTKNQVSLTCLVKGFYPSDIAVEWESNGQPENN YKTTPPVLDSDGSFFLYSRLTVDKSRWQEGNVFSCSVMHEALHN HYTQKSLSLSLG- |
| 40004 | | Anti-CD47 heavy chain | QVQLQESGPGLVKPSGTLSLTCAVSGVSIRSINWWNWVRQPPGK GLEWIGEIYHSGSTNYNPSLKSRVTISVDKSKNQFSLKLNSVTAAD TAVYYCARDGGIAVTDYYYGLDVWGQGTTVTVSSASTKGPSV FPLAPCSRSTSESTAALGCLVKDYFPEPVTVSWNSGALTSGVHTFP AVLQSSGLYSLSSVVTVPSSSLGTKTYTCNVDHKPSNTKVDKRVE SKYGPPCPSCPAPEFLGGPSVFLFPPKPKDTLMISRTPEVTCVVVD VSQEDPEVQFNWYVDGVEVHNAKTKPREEQFNSTYRVVSVLTVL HQDWLNGKEYKCKVSNKGLPSSIEKTISKAKGQPREPQVYTLPPS QEEMTKNQVSLTCLVKGFYPSDIAVEWESNGQPENNYKTTPPVL DSDGSFFLYSRLTVDKSRWQEGNVFSCSVMHEALHNHYTQKSLS LSLGK |
| 40005 | | Anti-CD47 light chain | EIVLTQSPATLSLSPGERATLSCRASESVSSNLAWYQQKPGQAPRL LIYGAFNRATGIPARFSGSGSGTDFTLTISSLEPEDFAVYYCQQRSD WFTFGGGTKVEIKTVAAPSVFIFPPSDEQLKSGTASVVCLLNNFYP REAKVQWKVDNALQSGNSQESVTEQDSKDSTYSLSSTLTLSKAD YEKHKVYACEVTHQGLSSPVTKSFNRGEC |
| 40006 | | Anti-CD47 VH CDR1 | SINWWN |
| 40007 | | Anti-CD47 VH CDR2 | EIYHSGSTNYNPSLKS |
| 40008 | | Anti-CD47 VH CDR3 | DGGIAVTDYYYGLDV |
| 40009 | | Anti-CD47 VL CDR1 | RASESVSSNLA |
| 40010 | | Anti-CD47 VL CDR2 | GAFNRAT |
| 40011 | | Anti-CD47 VL CDR3 | QQRSDWFT |

* The terminal K is cleaved during cell expression but is encoded for in the DNA sequence

SEQUENCE LISTING (40011 sequences)

SEQ ID NO: 1 - protein, 9 aa, Artificial Sequence
  Synthetic: Clone: 1;VH CDR1
GTFSSYAIS

SEQ ID NO: 2 - protein, 17 aa, Artificial Sequence
  Synthetic: Clone: 1;VH CDR2
SIIPIFGTANYAQKFQG

SEQ ID NO: 3 - protein, 14 aa, Artificial Sequence
  Synthetic: Clone: 1;VH CDR3
AREAGYYRYRYFDL

SEQ ID NO: 4 - protein, 11 aa, Artificial Sequence
  Synthetic: Clone: 1;VL CDR1
RASQSVSSNLA

SEQ ID NO: 5 - protein, 7 aa, Artificial Sequence
  Synthetic: Clone: 1;VL CDR2
GASTRAT

SEQ ID NO: 6 - protein, 9 aa, Artificial Sequence
  Synthetic: Clone: 1;VL CDR3
QQHALWPLT

SEQ ID NO: 7 - protein, 26 aa, Artificial Sequence
  Synthetic: Clone: 1;VH FR1
QVQLVQSGAEVKKPGSSVKVSCKASG

SEQ ID NO: 8 - protein, 14 aa, Artificial Sequence
  Synthetic: Clone: 1;VH FR2
WVRQAPGQGLEWMG

SEQ ID NO: 9 - protein, 30 aa, Artificial Sequence
  Synthetic: Clone: 1;VH FR3
RVTITADESTSTAYMELSSLRSEDTAVYYC

SEQ ID NO: 10 - protein, 11 aa, Artificial Sequence
  Synthetic: Clone: 1;VH FR4
WGRGTLVTVSS

SEQ ID NO: 11 - DNA, 363 bp, Artificial Sequence
  Synthetic: Clone: 1;VH DNA
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaagcatcatccctatctttggtacagcaaactacgcacagaagttccagggcagagtcacgattaccgcggacgaatccacgagcacagcctacatggagctgagcagcctgagatctgaggacacggcggtgtactactgcgccagagaagccggatactaccgctaccgatacttcgacctatgggggagaggtaccttggtcaccgtctcctca

SEQ ID NO: 12 - protein, 121 aa, Artificial Sequence
  Synthetic: Clone: 1;VH Protein
QVQLVQSGAEVKKPGSSVKVSCKASGGTFSSYAISWVRQAPGQGLEWMGSIIPIFGTANYAQKFQGRVTITADESTSTAYMELSSLRSEDTAVYYCAREAGYYRYRYFDLWGRGTLVTVSS

SEQ ID NO: 13 - protein, 23 aa, Artificial Sequence
  Synthetic: Clone: 1;VL FR1
EIVMTQSPATLSVSPGERATLSC

SEQ ID NO: 14 - protein, 15 aa, Artificial Sequence
  Synthetic: Clone: 1;VL FR2
WYQQKPGQAPRLLIY

SEQ ID NO: 15 - protein, 32 aa, Artificial Sequence
  Synthetic: Clone: 1;VL FR3
GIPARFSGSGSGTEFTLTISSLQSEDFAVYYC

SEQ ID NO: 16 - protein, 10 aa, Artificial Sequence
  Synthetic: Clone: 1;VL FR4
FGGGTKVEIK

SEQ ID NO: 17 - DNA, 321 bp, Artificial Sequence
  Synthetic: Clone: 1;VL DNA
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagcacgccctctggcctctcacttttggcggagggaccaaggttgagatcaaa

SEQ ID NO: 18 - protein, 107 aa, Artificial Sequence
  Synthetic: Clone: 1;VL Protein
EIVMTQSPATLSVSPGERATLSCRASQSVSSNLAWYQQKPGQAPRLLIYGASTRATGIPARFSGSGSGTEFTLTISSLQSEDFAVYYCQQHALWPLTFGGGTKVEIK

SEQ ID NO: 19-100 - skipped (82 entries)

SEQ ID NO: 101 - protein, 9 aa, Artificial Sequence
  Synthetic: Clone: 2;VH CDR1
GTFSSYAIG

SEQ ID NO: 102 - protein, 17 aa, Artificial Sequence
  Synthetic: Clone: 2;VH CDR2
GIIPIFGTANYAQKFQG

SEQ ID NO: 103 - protein, 12 aa, Artificial Sequence
  Synthetic: Clone: 2;VH CDR3
ARDPVRRSPFDI

SEQ ID NO: 104 - protein, 11 aa, Artificial Sequence
  Synthetic: Clone: 2;VL CDR1
RASQSVSSYLA

SEQ ID NO: 105 - protein, 7 aa, Artificial Sequence
  Synthetic: Clone: 2;VL CDR2
DSSNRAT

SEQ ID NO: 106 - protein, 9 aa, Artificial Sequence
  Synthetic: Clone: 2;VL CDR3
QQSFLWPRT

SEQ ID NO: 107 - protein, 26 aa, Artificial Sequence
  Synthetic: Clone: 2;VH FR1
QVQLVQSGAEVKKPGSSVKVSCKASG

SEQ ID NO: 108 - protein, 14 aa, Artificial Sequence
  Synthetic: Clone: 2;VH FR2
WVRQAPGQGLEWMG

SEQ ID NO: 109 - protein, 30 aa, Artificial Sequence; identical to SEQ ID NO: 9
  Synthetic: Clone: 2;VH FR3

SEQ ID NO: 110 - protein, 11 aa, Artificial Sequence
  Synthetic: Clone: 2;VH FR4
WGQGTMVTVSS

SEQ ID NO: 111 - DNA, 357 bp, Artificial Sequence
  Synthetic: Clone: 2;VH DNA
caggtgcagctggtgcagtctggggctgaggtgaagaagcctgggtcctcggtgaaggtctcctgcaaggcttctggaggcaccttcagcagctatgctatcggctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagagatccggtgagaagaagcccattcgacatatggggtcagggtacaatggtcaccgtctcctca

SEQ ID NO: 112 - protein, 119 aa, Artificial Sequence
  Synthetic: Clone: 2;VH Protein
QVQLVQSGAEVKKPGSSVKVSCKASGGTFSSYAIGWVRQAPGQGLEWMGGIIPIFGTANYAQKFQGRVTITADESTSTAYMELSSLRSEDTAVYYCARDPVRRSPFDIWGQGTMVTVSS

SEQ ID NO: 113 - protein, 23 aa, Artificial Sequence
  Synthetic: Clone: 2;VL FR1
EIVLTQSPATLSLSPGERATLSC

SEQ ID NO: 114 - protein, 15 aa, Artificial Sequence
  Synthetic: Clone: 2;VL FR2
WYQQKPGQAPRLLIY

SEQ ID NO: 115 - protein, 32 aa, Artificial Sequence
  Synthetic: Clone: 2;VL FR3
GIPARFSGSGSGTDFTLTISSLEPEDFAVYYC

SEQ ID NO: 116 - protein, 10 aa, Artificial Sequence
  Synthetic: Clone: 2;VL FR4
FGGGTKVEIK

SEQ ID NO: 117 - DNA, 321 bp, Artificial Sequence
  Synthetic: Clone: 2;VL DNA
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcagtccttcctctggcctaggacttttggcggagggaccaaggttgagatcaaa

SEQ ID NO: 118 - protein, 107 aa, Artificial Sequence
  Synthetic: Clone: 2;VL Protein
EIVLTQSPATLSLSPGERATLSCRASQSVSSYLAWYQQKPGQAPRLLIYDSSNRATGIPARFSGSGSGTDFTLTISSLEPEDFAVYYCQQSFLWPRTFGGGTKVEIK

SEQ ID NO: 119-200 - skipped (82 entries)

SEQ ID NO: 201 - protein, 9 aa, Artificial Sequence
  Synthetic: Clone: 3;VH CDR1
FTFSSYAMS

SEQ ID NO: 202 - protein, 17 aa, Artificial Sequence
  Synthetic: Clone: 3;VH CDR2
TISGSGGSTYYADSVKG

SEQ ID NO: 203 - protein, 19 aa, Artificial Sequence
  Synthetic: Clone: 3;VH CDR3
AKGPRYDSSGYRWRYGMDV

SEQ ID NO: 204 - protein, 11 aa, Artificial Sequence
  Synthetic: Clone: 3;VL CDR1
RASQSISSYLN

SEQ ID NO: 205 - protein, 7 aa, Artificial Sequence
  Synthetic: Clone: 3;VL CDR2
AASSLQS

SEQ ID NO: 206 - protein, 10 aa, Artificial Sequence
  Synthetic: Clone: 3;VL CDR3
QQLYVDPPWT

SEQ ID NO: 207 - protein, 26 aa, Artificial Sequence
  Synthetic: Clone: 3;VH FR1
EVQLLESGGGLVQPGGSLRLSCAASG

SEQ ID NO: 208 - protein, 14 aa, Artificial Sequence
  Synthetic: Clone: 3;VH FR2
WVRQAPGKGLEWVS

SEQ ID NO: 209 - protein, 30 aa, Artificial Sequence
  Synthetic: Clone: 3;VH FR3
RFTISRDNSKNTLYLQMNSLRAEDTAVYYC

SEQ ID NO: 210 - protein, 11 aa, Artificial Sequence
  Synthetic: Clone: 3;VH FR4
WGQGTTVTVSS

SEQ ID NO: 211 - DNA, 378 bp, Artificial Sequence
  Synthetic: Clone: 3;VH DNA
gaggtgcagctgttggagtctgggggaggcttggtacaacctggggggtccctgagactctcctgtgcagcctctggattcacctttagcagctatgccatgagctgggtccgccaggctccagggaaggggctggagtgggtctcaaccattagtggtagtggtggtagcacatactacgcagactccgtgaagggccggttcaccatctccagagacaattccaagaacacgctgtatctgcaaatgaacagcctgagagccgaggacacggcggtgtactactgcgccaagggccccagatacgacagcagcggataccgatggagatacggaatggacgtatggggccagggaacaactgtcaccgtctcctca

SEQ ID NO: 212 - protein, 126 aa, Artificial Sequence
  Synthetic: Clone: 3;VH Protein
EVQLLESGGGLVQPGGSLRLSCAASGFTFSSYAMSWVRQAPGKGLEWVSTISGSGGSTYYADSVKGRFTISRDNSKNTLYLQMNSLRAEDTAVYYCAKGPRYDSSGYRWRYGMDVWGQGTTVTVSS

SEQ ID NO: 213 - protein, 23 aa, Artificial Sequence
  Synthetic: Clone: 3;VL FR1
DIQMTQSPSSLSASVGDRVTITC

SEQ ID NO: 214 - protein, 15 aa, Artificial Sequence
  Synthetic: Clone: 3;VL FR2
WYQQKPGKAPKLLIY

SEQ ID NO: 215 - protein, 32 aa, Artificial Sequence
  Synthetic: Clone: 3;VL FR3
GVPSRFSGSGSGTDFTLTISSLQPEDFATYYC

SEQ ID NO: 216 - protein, 10 aa, Artificial Sequence
  Synthetic: Clone: 3;VL FR4
FGGGTKVEIK

SEQ ID NO: 217 - DNA, 324 bp, Artificial Sequence
  Synthetic: Clone: 3;VL DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcagcaactatacgtcgaccctccttggactttcggcggagggaccaaggtggagatcaaa

SEQ ID NO: 218 - protein, 108 aa, Artificial Sequence
  Synthetic: Clone: 3;VL Protein
DIQMTQSPSSLSASVGDRVTITCRASQSISSYLNWYQQKPGKAPKLLIYAASSLQSGVPSRFSGSGSGTDFTLTISSLQPEDFATYYCQQLYVDPPWTFGGGTKVEIK

SEQ ID NO: 219-300 - skipped (82 entries)

SEQ ID NO: 301 - protein, 9 aa, Artificial Sequence
  Synthetic: Clone: 4;VH CDR1
FTFSSYAMS

SEQ ID NO: 302 - protein, 17 aa, Artificial Sequence
  Synthetic: Clone: 4;VH CDR2
AISASGGSTYYADSVKG

SEQ ID NO: 303 - protein, 19 aa, Artificial Sequence
  Synthetic: Clone: 4;VH CDR3
AKGPRYDSSGYRWRYGMDV

SEQ ID NO: 304 - protein, 11 aa, Artificial Sequence
  Synthetic: Clone: 4;VL CDR1
RASQSISSYLN

SEQ ID NO: 305 - protein, 7 aa, Artificial Sequence
  Synthetic: Clone: 4;VL CDR2
AASSLQS

SEQ ID NO: 306 - protein, 9 aa, Artificial Sequence
  Synthetic: Clone: 4;VL CDR3
QQLALTPYT

SEQ ID NO: 307 - protein, 26 aa, Artificial Sequence
  Synthetic: Clone: 4;VH FR1
EVQLLESGGGLVQPGGSLRLSCAASG

SEQ ID NO: 308 - protein, 14 aa, Artificial Sequence
  Synthetic: Clone: 4;VH FR2
WVRQAPGKGLEWVS

SEQ ID NO: 309 - protein, 30 aa, Artificial Sequence; identical to SEQ ID NO: 209
  Synthetic: Clone: 4;VH FR3

SEQ ID NO: 310 - protein, 11 aa, Artificial Sequence
  Synthetic: Clone: 4;VH FR4
WGQGTTVTVSS

SEQ ID NO: 311 - DNA, 378 bp, Artificial Sequence
  Synthetic: Clone: 4;VH DNA
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtgctagtggtggtagcacatactacgcagactccgtgaagggccggttcaccatctccagagacaattccaagaacacgctgtatctgcaaatgaacagcctgagagccgaggacacggcggtgtactactgcgccaagggccccagatacgacagcagcggataccgatggagatacggaatggacgtatggggccagggaacaactgtcaccgtctcctca

SEQ ID NO: 312 - protein, 126 aa, Artificial Sequence
  Synthetic: Clone: 4;VH Protein
EVQLLESGGGLVQPGGSLRLSCAASGFTFSSYAMSWVRQAPGKGLEWVSAISASGGSTYYADSVKGRFTISRDNSKNTLYLQMNSLRAEDTAVYYCAKGPRYDSSGYRWRYGMDVWGQGTTVTVSS

SEQ ID NO: 313 - protein, 23 aa, Artificial Sequence
  Synthetic: Clone: 4;VL FR1
DIQMTQSPSSLSASVGDRVTITC

SEQ ID NO: 314 - protein, 15 aa, Artificial Sequence
  Synthetic: Clone: 4;VL FR2
WYQQKPGKAPKLLIY

SEQ ID NO: 315 - protein, 32 aa, Artificial Sequence; identical to SEQ ID NO: 215
  Synthetic: Clone: 4;VL FR3

SEQ ID NO: 316 - protein, 10 aa, Artificial Sequence
  Synthetic: Clone: 4;VL FR4
FGGGTKVEIK

SEQ ID NO: 317 - DNA, 321 bp, Artificial Sequence
  Synthetic: Clone: 4;VL DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcagcaactagccctcactccttacacttttggcggagggaccaaggttgagatcaaa

SEQ ID NO: 318 - protein, 107 aa, Artificial Sequence
  Synthetic: Clone: 4;VL Protein
DIQMTQSPSSLSASVGDRVTITCRASQSISSYLNWYQQKPGKAPKLLIYAASSLQSGVPSRFSGSGSGTDFTLTISSLQPEDFATYYCQQLALTPYTFGGGTKVEIK

SEQ ID NO: 319-400 - skipped (82 entries)

SEQ ID NO: 401 - protein, 9 aa, Artificial Sequence
  Synthetic: Clone: 5;VH CDR1
YTFTGYYMH

SEQ ID NO: 402 - protein, 17 aa, Artificial Sequence
  Synthetic: Clone: 5;VH CDR2
WINPNSGGTNYAQKFQG

SEQ ID NO: 403 - protein, 17 aa, Artificial Sequence
  Synthetic: Clone: 5;VH CDR3
ARDAPFYTWDHYYGMDV

SEQ ID NO: 404 - protein, 11 aa, Artificial Sequence
  Synthetic: Clone: 5;VL CDR1
QASQDISNYLN

SEQ ID NO: 405 - protein, 7 aa, Artificial Sequence
  Synthetic: Clone: 5;VL CDR2
DASNLAT

SEQ ID NO: 406 - protein, 9 aa, Artificial Sequence
  Synthetic: Clone: 5;VL CDR3
QQLYHLPIT

SEQ ID NO: 407 - protein, 26 aa, Artificial Sequence
  Synthetic: Clone: 5;VH FR1
QVQLVQSGAEVKKPGASVKVSCKASG

SEQ ID NO: 408 - protein, 14 aa, Artificial Sequence
  Synthetic: Clone: 5;VH FR2
WVRQAPGQGLEWMG

SEQ ID NO: 409 - protein, 30 aa, Artificial Sequence
  Synthetic: Clone: 5;VH FR3
RVTMTRDTSISTAYMELSRLRSDDTAVYYC

SEQ ID NO: 410 - protein, 11 aa, Artificial Sequence
  Synthetic: Clone: 5;VH FR4
WGQGTTVTVSS

SEQ ID NO: 411 - DNA, 372 bp, Artificial Sequence
  Synthetic: Clone: 5;VH DNA
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggcggtgtactactgcgccagagatgctcctttctacacctgggatcactactacggaatggacgtatggggccagggaacaactgtcaccgtctcctca

SEQ ID NO: 412 - protein, 124 aa, Artificial Sequence
  Synthetic: Clone: 5;VH Protein
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDAPFYTWDHYYGMDVWGQGTTVTVSS

SEQ ID NO: 413 - protein, 23 aa, Artificial Sequence
  Synthetic: Clone: 5;VL FR1
DIQMTQSPSSLSASVGDRVTITC

SEQ ID NO: 414 - protein, 15 aa, Artificial Sequence
  Synthetic: Clone: 5;VL FR2
WYQQKPGKAPKLLIY

SEQ ID NO: 415 - protein, 32 aa, Artificial Sequence
  Synthetic: Clone: 5;VL FR3
GVPSRFSGSGSGTDFTFTISSLQPEDIATYYC

SEQ ID NO: 416 - protein, 10 aa, Artificial Sequence
  Synthetic: Clone: 5;VL FR4
FGGGTKVEIK

SEQ ID NO: 417 - DNA, 321 bp, Artificial Sequence
  Synthetic: Clone: 5;VL DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggcaacaggggtcccatcaaggttcagtggaagtggatctgggacagattttactttcaccatcagcagcctgcagcctgaagatattgcaacatattactgtcagcagctctaccacctccctatcacttttggcggagggaccaaggttgagatcaaa

SEQ ID NO: 418 - protein, 107 aa, Artificial Sequence
  Synthetic: Clone: 5;VL Protein
DIQMTQSPSSLSASVGDRVTITCQASQDISNYLNWYQQKPGKAPKLLIYDASNLATGVPSRFSGSGSGTDFTFTISSLQPEDIATYYCQQLYHLPITFGGGTKVEIK

SEQ ID NO: 419-500 - skipped (82 entries)

SEQ ID NO: 501 - protein, 9 aa, Artificial Sequence
  Synthetic: Clone: 6;VH CDR1
FTFSSYGMS

SEQ ID NO: 502 - protein, 17 aa, Artificial Sequence
  Synthetic: Clone: 6;VH CDR2
NIKQDGSEKYYVDSVKG

SEQ ID NO: 503 - protein, 15 aa, Artificial Sequence
  Synthetic: Clone: 6;VH CDR3
ARDFTRWSHVNWFDP

SEQ ID NO: 504 - protein, 11 aa, Artificial Sequence
  Synthetic: Clone: 6;VL CDR1
RASQSVSSSLA

SEQ ID NO: 505 - protein, 7 aa, Artificial Sequence
  Synthetic: Clone: 6;VL CDR2
GASTRAT

SEQ ID NO: 506 - protein, 9 aa, Artificial Sequence
  Synthetic: Clone: 6;VL CDR3
QQYYHHPYT

SEQ ID NO: 507 - protein, 26 aa, Artificial Sequence
  Synthetic: Clone: 6;VH FR1
EVQLVESGGGLVQPGGSLRLSCAASG

SEQ ID NO: 508 - protein, 14 aa, Artificial Sequence
  Synthetic: Clone: 6;VH FR2
WVRQAPGKGLEWVA

SEQ ID NO: 509 - protein, 30 aa, Artificial Sequence
  Synthetic: Clone: 6;VH FR3
RFTISRDNAKNSLYLQMNSLRAEDTAVYYC

SEQ ID NO: 510 - protein, 11 aa, Artificial Sequence
  Synthetic: Clone: 6;VH FR4
WGQGTLVTVSS

SEQ ID NO: 511 - DNA, 366 bp, Artificial Sequence
  Synthetic: Clone: 6;VH DNA
gaggtgcagctggtggagtctgggggaggcttggtccagcctggggggtccctgagactctcctgtgcagcctctggattcacctttagtagctatgggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggcggtgtactactgcgctagggatttcactagatggtcccacgtgaactggtttgatccctggggacagggtacattggtcaccgtctcctca

SEQ ID NO: 512 - protein, 122 aa, Artificial Sequence
  Synthetic: Clone: 6;VH Protein
EVQLVESGGGLVQPGGSLRLSCAASGFTFSSYGMSWVRQAPGKGLEWVANIKQDGSEKYYVDSVKGRFTISRDNAKNSLYLQMNSLRAEDTAVYYCARDFTRWSHVNWFDPWGQGTLVTVSS

SEQ ID NO: 513 - protein, 23 aa, Artificial Sequence
  Synthetic: Clone: 6;VL FR1
EIVMTQSPATLSVSPGERATLSC

SEQ ID NO: 514 - protein, 15 aa, Artificial Sequence
  Synthetic: Clone: 6;VL FR2
WYQQKPGQAPRLLIF

SEQ ID NO: 515 - protein, 32 aa, Artificial Sequence; identical to SEQ ID NO: 15
  Synthetic: Clone: 6;VL FR3

SEQ ID NO: 516 - protein, 10 aa, Artificial Sequence
  Synthetic: Clone: 6;VL FR4
FGGGTKVEIK

SEQ ID NO: 517 - DNA, 321 bp, Artificial Sequence
  Synthetic: Clone: 6;VL DNA
gaaatagtgatgacgcagtctccagccaccctgtctgtgtctccaggggaaagagccaccctctcctgcagggccagtcagagtgttagcagcagcttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttattactgtcagcagtactaccaccacccttacacttttggcggagggaccaaggttgagatcaaa

SEQ ID NO: 518 - protein, 107 aa, Artificial Sequence
  Synthetic: Clone: 6;VL Protein
EIVMTQSPATLSVSPGERATLSCRASQSVSSSLAWYQQKPGQAPRLLIFGASTRATGIPARFSGSGSGTEFTLTISSLQSEDFAVYYCQQYYHHPYTFGGGTKVEIK

SEQ ID NO: 519-600 - skipped (82 entries)

SEQ ID NO: 601 - protein, 10 aa, Artificial Sequence
  Synthetic: Clone: 7;VH CDR1
YSISSGYYWA

SEQ ID NO: 602 - protein, 16 aa, Artificial Sequence
  Synthetic: Clone: 7;VH CDR2
SIYHSGSTYYNPSLKS

SEQ ID NO: 603 - protein, 13 aa, Artificial Sequence
  Synthetic: Clone: 7;VH CDR3
ARGAGHRQFAFDI

SEQ ID NO: 604 - protein, 17 aa, Artificial Sequence
  Synthetic: Clone: 7;VL CDR1
KSSQSVLYSSNNKNYLA

SEQ ID NO: 605 - protein, 7 aa, Artificial Sequence
  Synthetic: Clone: 7;VL CDR2
WASTRES

SEQ ID NO: 606 - protein, 9 aa, Artificial Sequence
  Synthetic: Clone: 7;VL CDR3
QQFASSPWT

SEQ ID NO: 607 - protein, 26 aa, Artificial Sequence
  Synthetic: Clone: 7;VH FR1
QVQLQESGPGLVKPSETLSLTCAVSG

SEQ ID NO: 608 - protein, 14 aa, Artificial Sequence
  Synthetic: Clone: 7;VH FR2
WIRQPPGKGLEWIG

SEQ ID NO: 609 - protein, 30 aa, Artificial Sequence
  Synthetic: Clone: 7;VH FR3
RVTISVDTSKNQFSLKLSSVTAADTAVYYC

SEQ ID NO: 610 - protein, 11 aa, Artificial Sequence
  Synthetic: Clone: 7;VH FR4
WGQGTMVTVSS

SEQ ID NO: 611 - DNA, 360 bp, Artificial Sequence
  Synthetic: Clone: 7;VH DNA
caggtgcagctgcaggagtcgggcccaggactggtgaagccttcggagaccctgtccctcacctgcgctgtctctggttactccatcagcagtggttactactgggcttggatccggcagcccccagggaaggggctggagtggattgggagtatctatcatagtgggagcacctactacaacccgtccctcaagagtcgagtcaccatatcagtagacacgtccaagaaccagttctccctgaagctgagttctgtgaccgccgcagacacggcggtgtactactgcgccagaggtgccggacacagacagttcgcattcgatatctggggtcagggtacaatggtcaccgtctcctca

SEQ ID NO: 612 - protein, 120 aa, Artificial Sequence
  Synthetic: Clone: 7;VH Protein
QVQLQESGPGLVKPSETLSLTCAVSGYSISSGYYWAWIRQPPGKGLEWIGSIYHSGSTYYNPSLKSRVTISVDTSKNQFSLKLSSVTAADTAVYYCARGAGHRQFAFDIWGQGTMVTVSS

SEQ ID NO: 613 - protein, 23 aa, Artificial Sequence
  Synthetic: Clone: 7;VL FR1
DIVMTQSPDSLAVSLGERATINC

SEQ ID NO: 614 - protein, 15 aa, Artificial Sequence
  Synthetic: Clone: 7;VL FR2
WYQQKPGQPPKLLIY

SEQ ID NO: 615 - protein, 32 aa, Artificial Sequence
  Synthetic: Clone: 7;VL FR3
GVPDRFSGSGSGTDFTLTISSLQAEDVAVYYC

SEQ ID NO: 616 - protein, 10 aa, Artificial Sequence
  Synthetic: Clone: 7;VL FR4
FGGGTKVEIK

SEQ ID NO: 617 - DNA, 339 bp, Artificial Sequence
  Synthetic: Clone: 7;VL DNA
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgccagttccccttggacttttggcggagggaccaaggttgagatcaaa

SEQ ID NO: 618 - protein, 113 aa, Artificial Sequence
  Synthetic: Clone: 7;VL Protein
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFASSPWTFGGGTKVEIK

SEQ ID NO: 619-700 - skipped (82 entries)

SEQ ID NO: 701 - protein, 11 aa, Artificial Sequence
  Synthetic: Clone: 8;VH CDR1
GSISSSSYYWG

SEQ ID NO: 702 - protein, 16 aa, Artificial Sequence
  Synthetic: Clone: 8;VH CDR2
SIYYSGSTYYNPSLKS

SEQ ID NO: 703 - protein, 12 aa, Artificial Sequence
  Synthetic: Clone: 8;VH CDR3
ARGSPTYHDFDL

SEQ ID NO: 704 - protein, 11 aa, Artificial Sequence
  Synthetic: Clone: 8;VL CDR1
RASQSVSSYLA

SEQ ID NO: 705 - protein, 7 aa, Artificial Sequence
  Synthetic: Clone: 8;VL CDR2
DASNRAT

SEQ ID NO: 706 - protein, 9 aa, Artificial Sequence
  Synthetic: Clone: 8;VL CDR3
QQRAIWPPT

SEQ ID NO: 707 - protein, 26 aa, Artificial Sequence
  Synthetic: Clone: 8;VH FR1
QLQLQESGPGLVKPSETLSLTCTVSG

SEQ ID NO: 708 - protein, 14 aa, Artificial Sequence
  Synthetic: Clone: 8;VH FR2
WIRQPPGKGLEWIG

SEQ ID NO: 709 - protein, 30 aa, Artificial Sequence; identical to SEQ ID NO: 609
  Synthetic: Clone: 8;VH FR3

SEQ ID NO: 710 - protein, 11 aa, Artificial Sequence
  Synthetic: Clone: 8;VH FR4
WGRGTLVTVSS

SEQ ID NO: 711 - DNA, 360 bp, Artificial Sequence
  Synthetic: Clone: 8;VH DNA
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagttctgtgaccgccgcagacacggcggtgtactactgcgccagaggttcccctacataccacgacttcgacctatgggggagaggtaccttggtcaccgtctcctca

SEQ ID NO: 712 - protein, 120 aa, Artificial Sequence
  Synthetic: Clone: 8;VH Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGSPTYHDFDLWGRGTLVTVSS

SEQ ID NO: 713 - protein, 23 aa, Artificial Sequence
  Synthetic: Clone: 8;VL FR1
EIVLTQSPATLSLSPGERATLSC

SEQ ID NO: 714 - protein, 15 aa, Artificial Sequence
  Synthetic: Clone: 8;VL FR2
WYQQKPGQAPRLLIY

SEQ ID NO: 715 - protein, 32 aa, Artificial Sequence; identical to SEQ ID NO: 115
  Synthetic: Clone: 8;VL FR3

SEQ ID NO: 716 - protein, 10 aa, Artificial Sequence
  Synthetic: Clone: 8;VL FR4
FGGGTKVEIK

SEQ ID NO: 717 - DNA, 321 bp, Artificial Sequence
  Synthetic: Clone: 8;VL DNA
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagagccatctggcctcctacttttggcggagggaccaaggttgagatcaaa

SEQ ID NO: 718 - protein, 107 aa, Artificial Sequence
  Synthetic: Clone: 8;VL Protein
EIVLTQSPATLSLSPGERATLSCRASQSVSSYLAWYQQKPGQAPRLLIYDASNRATGIPARFSGSGSGTDFTLTISSLEPEDFAVYYCQQRAIWPPTFGGGTKVEIK

SEQ ID NO: 719-800 - skipped (82 entries)

SEQ ID NO: 801 - protein, 10 aa, Artificial Sequence
  Synthetic: Clone: 9;VH CDR1
YSISSGYYWA

SEQ ID NO: 802 - protein, 16 aa, Artificial Sequence
  Synthetic: Clone: 9;VH CDR2
SIYHSGSTYYNPSLKS

SEQ ID NO: 803 - protein, 13 aa, Artificial Sequence
  Synthetic: Clone: 9;VH CDR3
ARGAGHRQFAFDI

SEQ ID NO: 804 - protein, 17 aa, Artificial Sequence
  Synthetic: Clone: 9;VL CDR1
KSSQSVLYSSNNKNYLA

SEQ ID NO: 805 - protein, 7 aa, Artificial Sequence
  Synthetic: Clone: 9;VL CDR2
WASTRES

SEQ ID NO: 806 - protein, 9 aa, Artificial Sequence
  Synthetic: Clone: 9;VL CDR3
QQFHFTPWT

SEQ ID NO: 807 - protein, 26 aa, Artificial Sequence
  Synthetic: Clone: 9;VH FR1
QVQLQESGPGLVKPSETLSLTCAVSG

SEQ ID NO: 808 - protein, 14 aa, Artificial Sequence
  Synthetic: Clone: 9;VH FR2
WIRQPPGKGLEWIG

SEQ ID NO: 809 - protein, 30 aa, Artificial Sequence; identical to SEQ ID NO: 609
  Synthetic: Clone: 9;VH FR3

SEQ ID NO: 810 - protein, 11 aa, Artificial Sequence
  Synthetic: Clone: 9;VH FR4
WGQGTMVTVSS

SEQ ID NO: 811 - DNA, 360 bp, Artificial Sequence; identical to SEQ ID NO: 611
  Synthetic: Clone: 9;VH DNA

SEQ ID NO: 812 - protein, 120 aa, Artificial Sequence; identical to SEQ ID NO: 612
  Synthetic: Clone: 9;VH Protein

SEQ ID NO: 813 - protein, 23 aa, Artificial Sequence
  Synthetic: Clone: 9;VL FR1
DIVMTQSPDSLAVSLGERATINC

SEQ ID NO: 814 - protein, 15 aa, Artificial Sequence
  Synthetic: Clone: 9;VL FR2
WYQQKPGQPPKLLIY

SEQ ID NO: 815 - protein, 32 aa, Artificial Sequence; identical to SEQ ID NO: 615
  Synthetic: Clone: 9;VL FR3

SEQ ID NO: 816 - protein, 10 aa, Artificial Sequence
  Synthetic: Clone: 9;VL FR4
FGGGTKVEIK

SEQ ID NO: 817 - DNA, 339 bp, Artificial Sequence
  Synthetic: Clone: 9;VL DNA
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttccacttcactccttggacttttggcggagggaccaaggttgagatcaaa

SEQ ID NO: 818 - protein, 113 aa, Artificial Sequence
  Synthetic: Clone: 9;VL Protein
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFHFTPWTFGGGTKVEIK

SEQ ID NO: 819-900 - skipped (82 entries)

SEQ ID NO: 901 - protein, 9 aa, Artificial Sequence
  Synthetic: Clone: 10;VH CDR1
GTFSNYAIS

SEQ ID NO: 902 - protein, 17 aa, Artificial Sequence
  Synthetic: Clone: 10;VH CDR2
GIIPIFGTANYAQKFQG

SEQ ID NO: 903 - protein, 17 aa, Artificial Sequence
  Synthetic: Clone: 10;VH CDR3
ARPRGDYSGYDAGPIDY

SEQ ID NO: 904 - protein, 11 aa, Artificial Sequence
  Synthetic: Clone: 10;VL CDR1
RASQSVSSYLA

SEQ ID NO: 905 - protein, 7 aa, Artificial Sequence
  Synthetic: Clone: 10;VL CDR2
DASNRAT

SEQ ID NO: 906 - protein, 9 aa, Artificial Sequence
  Synthetic: Clone: 10;VL CDR3
QQRFHFPPT

SEQ ID NO: 907 - protein, 26 aa, Artificial Sequence
  Synthetic: Clone: 10;VH FR1
QVQLVQSGAEVKKPGSSVKVSCKASG

SEQ ID NO: 908 - protein, 14 aa, Artificial Sequence
  Synthetic: Clone: 10;VH FR2
WVRQAPGQGLEWMG

SEQ ID NO: 909 - protein, 30 aa, Artificial Sequence; identical to SEQ ID NO: 9
  Synthetic: Clone: 10;VH FR3

SEQ ID NO: 910 - protein, 11 aa, Artificial Sequence
  Synthetic: Clone: 10;VH FR4
WGQGTLVTVSS

SEQ ID NO: 911 - DNA, 372 bp, Artificial Sequence
  Synthetic: Clone: 10;VH DNA
caggtgcagctggtgcagtctggggctgaggtgaagaagcctgggtcctcggtgaaggtctcctgcaaggcttctggaggcaccttcagcaactatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagacccagaggcgactacagcggatacgacgcaggtcccattgactactggggacagggtacattggtcaccgtctcctca

SEQ ID NO: 912 - protein, 124 aa, Artificial Sequence
  Synthetic: Clone: 10;VH Protein
QVQLVQSGAEVKKPGSSVKVSCKASGGTFSNYAISWVRQAPGQGLEWMGGIIPIFGTANYAQKFQGRVTITADESTSTAYMELSSLRSEDTAVYYCARPRGDYSGYDAGPIDYWGQGTLVTVSS

SEQ ID NO: 913 - protein, 23 aa, Artificial Sequence
  Synthetic: Clone: 10;VL FR1
EIVLTQSPATLSLSPGERATLSC

SEQ ID NO: 914 - protein, 15 aa, Artificial Sequence
  Synthetic: Clone: 10;VL FR2
WYQQKPGQAPRLLIY

SEQ ID NO: 915 - protein, 32 aa, Artificial Sequence; identical to SEQ ID NO: 115
  Synthetic: Clone: 10;VL FR3

SEQ ID NO: 916 - protein, 10 aa, Artificial Sequence
  Synthetic: Clone: 10;VL FR4
FGGGTKVEIK

SEQ ID NO: 917 - DNA, 321 bp, Artificial Sequence
  Synthetic: Clone: 10;VL DNA
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattccacttccctcctacttttggcggagggaccaaggttgagatcaaa

SEQ ID NO: 918 - protein, 107 aa, Artificial Sequence
  Synthetic: Clone: 10;VL Protein
EIVLTQSPATLSLSPGERATLSCRASQSVSSYLAWYQQKPGQAPRLLIYDASNRATGIPARFSGSGSGTDFTLTISSLEPEDFAVYYCQQRFHFPPTFGGGTKVEIK

SEQ ID NO: 919-1000 - skipped (82 entries)

SEQ ID NO: 1001 - protein, 9 aa, Artificial Sequence
  Synthetic: Clone: 11;VH CDR1
GTFSNYAIS

SEQ ID NO: 1002 - protein, 17 aa, Artificial Sequence
  Synthetic: Clone: 11;VH CDR2
GIIPIFGTANYAQKFQG

SEQ ID NO: 1003 - protein, 17 aa, Artificial Sequence
  Synthetic: Clone: 11;VH CDR3
ARPRGDYSGYDAGPIDY

SEQ ID NO: 1004 - protein, 11 aa, Artificial Sequence
  Synthetic: Clone: 11;VL CDR1
RASQSVSSYLA

SEQ ID NO: 1005 - protein, 7 aa, Artificial Sequence
  Synthetic: Clone: 11;VL CDR2
DSSNRAT

SEQ ID NO: 1006 - protein, 9 aa, Artificial Sequence
  Synthetic: Clone: 11;VL CDR3
QQRYLFPIT

SEQ ID NO: 1007 - protein, 26 aa, Artificial Sequence
  Synthetic: Clone: 11;VH FR1
QVQLVQSGAEVKKPGSSVKVSCKASG

SEQ ID NO: 1008 - protein, 14 aa, Artificial Sequence
  Synthetic: Clone: 11;VH FR2
WVRQAPGQGLEWMG

SEQ ID NO: 1009 - protein, 30 aa, Artificial Sequence; identical to SEQ ID NO: 9
  Synthetic: Clone: 11;VH FR3

SEQ ID NO: 1010 - protein, 11 aa, Artificial Sequence
  Synthetic: Clone: 11;VH FR4
WGQGTLVTVSS

SEQ ID NO: 1011 - DNA, 372 bp, Artificial Sequence; identical to SEQ ID NO: 911
  Synthetic: Clone: 11;VH DNA

SEQ ID NO: 1012 - protein, 124 aa, Artificial Sequence; identical to SEQ ID NO: 912
  Synthetic: Clone: 11;VH Protein

SEQ ID NO: 1013 - protein, 23 aa, Artificial Sequence
  Synthetic: Clone: 11;VL FR1
EIVMTQSPATLSLSPGERATLSC

SEQ ID NO: 1014 - protein, 15 aa, Artificial Sequence
  Synthetic: Clone: 11;VL FR2
WYQQKPGQAPRLLIY

SEQ ID NO: 1015 - protein, 32 aa, Artificial Sequence; identical to SEQ ID NO: 115
  Synthetic: Clone: 11;VL FR3

SEQ ID NO: 1016 - protein, 10 aa, Artificial Sequence
  Synthetic: Clone: 11;VL FR4
FGGGTKVEIK

SEQ ID NO: 1017 - DNA, 321 bp, Artificial Sequence
  Synthetic: Clone: 11;VL DNA
gaaattgtgatgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcagagatacctcttccctatcacttttggcggagggaccaaggttgagatcaaa

SEQ ID NO: 1018 - protein, 107 aa, Artificial Sequence
  Synthetic: Clone: 11;VL Protein
EIVMTQSPATLSLSPGERATLSCRASQSVSSYLAWYQQKPGQAPRLLIYDSSNRATGIPARFSGSGSGTDFTLTISSLEPEDFAVYYCQQRYLFPITFGGGTKVEIK

SEQ ID NO: 1019-2000 - skipped (982 entries)

SEQ ID NO: 2001 - protein, 9 aa, Artificial Sequence
  Synthetic: Clone: 12;VH CDR1
FTFSSYYMQ

SEQ ID NO: 2002 - protein, 17 aa, Artificial Sequence
  Synthetic: Clone: 12;VH CDR2
YISSSSSTIGYADSVKG

SEQ ID NO: 2003 - protein, 19 aa, Artificial Sequence
  Synthetic: Clone: 12;VH CDR3
AKGPRYDSSGYRWRYGMDV

SEQ ID NO: 2004 - protein, 11 aa, Artificial Sequence
  Synthetic: Clone: 12;VL CDR1
RASQSISSYLN

SEQ ID NO: 2005 - protein, 7 aa, Artificial Sequence
  Synthetic: Clone: 12;VL CDR2
AASSLQS

SEQ ID NO: 2006 - protein, 9 aa, Artificial Sequence
  Synthetic: Clone: 12;VL CDR3
QQLALTPYT

SEQ ID NO: 2007 - protein, 26 aa, Artificial Sequence
  Synthetic: Clone: 12;VH FR1
EVQLVESGGGLVQPGGSLRLSCAASG

SEQ ID NO: 2008 - protein, 14 aa, Artificial Sequence
  Synthetic: Clone: 12;VH FR2
WVRQAPGKGLEWVS

SEQ ID NO: 2009 - protein, 30 aa, Artificial Sequence; identical to SEQ ID NO: 509
  Synthetic: Clone: 12;VH FR3

SEQ ID NO: 2010 - protein, 11 aa, Artificial Sequence
  Synthetic: Clone: 12;VH FR4
WGQGTTVTVSS

SEQ ID NO: 2011 - DNA, 378 bp, Artificial Sequence
  Synthetic: Clone: 12;VH DNA
gaggtgcagctggtggagtctgggggaggcttggtacagcctggggggtccctgagactctcctgtgcagcctctggattcaccttcagtagctattatatgcagtgggtccgccaggctccagggaaggggctggagtgggtttcatacattagtagtagtagtagtaccataggttacgcagactctgtgaagggccgattcaccatctccagagacaatgccaagaactcactgtatctgcaaatgaacagcctgagagccgaggacacggcggtgtactactgcgccaagggccccagatacgacagcagcggataccgatggagatacggaatggacgtatggggccagggaacaactgtcaccgtctcctca

SEQ ID NO: 2012 - protein, 126 aa, Artificial Sequence
  Synthetic: Clone: 12;VH Protein
EVQLVESGGGLVQPGGSLRLSCAASGFTFSSYYMQWVRQAPGKGLEWVSYISSSSSTIGYADSVKGRFTISRDNAKNSLYLQMNSLRAEDTAVYYCAKGPRYDSSGYRWRYGMDVWGQGTTVTVSS

SEQ ID NO: 2013 - protein, 23 aa, Artificial Sequence
  Synthetic: Clone: 12;VL FR1
DIQMTQSPSSLSASVGDRVTITC

SEQ ID NO: 2014 - protein, 15 aa, Artificial Sequence
  Synthetic: Clone: 12;VL FR2
WYQQKPGKAPKLLIY

SEQ ID NO: 2015 - protein, 32 aa, Artificial Sequence; identical to SEQ ID NO: 215
  Synthetic: Clone: 12;VL FR3

SEQ ID NO: 2016 - protein, 10 aa, Artificial Sequence
  Synthetic: Clone: 12;VL FR4
FGGGTKVEIK

SEQ ID NO: 2017 - DNA, 321 bp, Artificial Sequence; identical to SEQ ID NO: 317
  Synthetic: Clone: 12;VL DNA

SEQ ID NO: 2018 - protein, 107 aa, Artificial Sequence; identical to SEQ ID NO: 318
  Synthetic: Clone: 12;VL Protein

SEQ ID NO: 2019-3000 - skipped (982 entries)

SEQ ID NO: 3001 - protein, 9 aa, Artificial Sequence
  Synthetic: Clone: 13;VH CDR1
GTFAEYAIS

SEQ ID NO: 3002 - protein, 17 aa, Artificial Sequence
  Synthetic: Clone: 13;VH CDR2
SILPIFGTANYAQKFQG

SEQ ID NO: 3003 - protein, 14 aa, Artificial Sequence
  Synthetic: Clone: 13;VH CDR3
AREAGYYRYRYFDL

SEQ ID NO: 3004 - protein, 11 aa, Artificial Sequence
  Synthetic: Clone: 13;VL CDR1
RASQSVSSNLA

SEQ ID NO: 3005 - protein, 7 aa, Artificial Sequence
  Synthetic: Clone: 13;VL CDR2
GASTRAT

SEQ ID NO: 3006 - protein, 9 aa, Artificial Sequence
  Synthetic: Clone: 13;VL CDR3
QQHALWPLT

SEQ ID NO: 3007 - protein, 26 aa, Artificial Sequence
  Synthetic: Clone: 13;VH FR1
QVQLVQSGAEVKKPGSSVKVSCKASG

SEQ ID NO: 3008 - protein, 14 aa, Artificial Sequence
  Synthetic: Clone: 13;VH FR2
WVRQAPGQGLEWMG

SEQ ID NO: 3009 - protein, 30 aa, Artificial Sequence; identical to SEQ ID NO: 9
  Synthetic: Clone: 13;VH FR3

SEQ ID NO: 3010 - protein, 11 aa, Artificial Sequence
  Synthetic: Clone: 13;VH FR4
WGRGTLVTVSS

SEQ ID NO: 3011 - DNA, 363 bp, Artificial Sequence
  Synthetic: Clone: 13;VH DNA
caggtgcagctggtgcagtctggggctgaggtgaagaagcctgggtcctcggtgaaggtctcctgcaaggcttctggaggcaccttcgctgagtatgctatcagctgggtgcgacaggcccctggacaagggcttgagtggatgggatctatccttcctatctttggtacagcaaactacgcacagaagttccagggcagagtcacgattaccgcggacgaatccacgagcacagcctacatggagctgagcagcctgagatctgaggacacggcggtgtactactgcgccagagaagccggatactaccgctaccgatacttcgacctatgggggagaggtaccttggtcaccgtctcctca

SEQ ID NO: 3012 - protein, 121 aa, Artificial Sequence
  Synthetic: Clone: 13;VH Protein
QVQLVQSGAEVKKPGSSVKVSCKASGGTFAEYAISWVRQAPGQGLEWMGSILPIFGTANYAQKFQGRVTITADESTSTAYMELSSLRSEDTAVYYCAREAGYYRYRYFDLWGRGTLVTVSS

SEQ ID NO: 3013 - protein, 23 aa, Artificial Sequence
  Synthetic: Clone: 13;VL FR1
EIVMTQSPATLSVSPGERATLSC

SEQ ID NO: 3014 - protein, 15 aa, Artificial Sequence
  Synthetic: Clone: 13;VL FR2
WYQQKPGQAPRLLIY

SEQ ID NO: 3015 - protein, 32 aa, Artificial Sequence; identical to SEQ ID NO: 15
  Synthetic: Clone: 13;VL FR3

SEQ ID NO: 3016 - protein, 10 aa, Artificial Sequence
  Synthetic: Clone: 13;VL FR4
FGGGTKVEIK

SEQ ID NO: 3017 - DNA, 321 bp, Artificial Sequence; identical to SEQ ID NO: 17
  Synthetic: Clone: 13;VL DNA

SEQ ID NO: 3018 - protein, 107 aa, Artificial Sequence; identical to SEQ ID NO: 18
  Synthetic: Clone: 13;VL Protein

SEQ ID NO: 3019-4000 - skipped (982 entries)

SEQ ID NO: 4001 - protein, 9 aa, Artificial Sequence
  Synthetic: Clone: 14;VH CDR1
GTFASYAIS

SEQ ID NO: 4002 - protein, 17 aa, Artificial Sequence
  Synthetic: Clone: 14;VH CDR2
SIIPEFGIANYAQKFQG

SEQ ID NO: 4003 - protein, 14 aa, Artificial Sequence
  Synthetic: Clone: 14;VH CDR3
AREAGYYRYRYFDL

SEQ ID NO: 4004 - protein, 11 aa, Artificial Sequence
  Synthetic: Clone: 14;VL CDR1
RASQSVSSNLA

SEQ ID NO: 4005 - protein, 7 aa, Artificial Sequence
  Synthetic: Clone: 14;VL CDR2
GASTRAT

SEQ ID NO: 4006 - protein, 9 aa, Artificial Sequence
  Synthetic: Clone: 14;VL CDR3
QQHALWPLT

SEQ ID NO: 4007 - protein, 26 aa, Artificial Sequence
  Synthetic: Clone: 14;VH FR1
QVQLVQSGAEVKKPGSSVKVSCKASG

SEQ ID NO: 4008 - protein, 14 aa, Artificial Sequence
  Synthetic: Clone: 14;VH FR2
WVRQAPGQGLEWMG

SEQ ID NO: 4009 - protein, 30 aa, Artificial Sequence; identical to SEQ ID NO: 9
  Synthetic: Clone: 14;VH FR3

SEQ ID NO: 4010 - protein, 11 aa, Artificial Sequence
  Synthetic: Clone: 14;VH FR4
WGRGTLVTVSS

SEQ ID NO: 4011 - DNA, 363 bp, Artificial Sequence
  Synthetic: Clone: 14;VH DNA
caggtgcagctggtgcagtctggggctgaggtgaagaagcctgggtcctcggtgaaggtctcctgcaaggcttctggaggcaccttcgctagctatgctatcagctgggtgcgacaggcccctggacaagggcttgagtggatgggatcgatcatccctgagtttggtattgcaaactacgcacagaagttccagggcagagtcacgattaccgcggacgaatccacgagcacagcctacatggagctgagcagcctgagatctgaggacacggcggtgtactactgcgccagagaagccggatactaccgctaccgatacttcgacctatgggggagaggtaccttggtcaccgtctcctca

SEQ ID NO: 4012 - protein, 121 aa, Artificial Sequence
  Synthetic: Clone: 14;VH Protein
QVQLVQSGAEVKKPGSSVKVSCKASGGTFASYAISWVRQAPGQGLEWMGSIIPEFGIANYAQKFQGRVTITADESTSTAYMELSSLRSEDTAVYYCAREAGYYRYRYFDLWGRGTLVTVSS

SEQ ID NO: 4013 - protein, 23 aa, Artificial Sequence
  Synthetic: Clone: 14;VL FR1
EIVMTQSPATLSVSPGERATLSC

SEQ ID NO: 4014 - protein, 15 aa, Artificial Sequence
  Synthetic: Clone: 14;VL FR2
WYQQKPGQAPRLLIY

SEQ ID NO: 4015 - protein, 32 aa, Artificial Sequence; identical to SEQ ID NO: 15
  Synthetic: Clone: 14;VL FR3

SEQ ID NO: 4016 - protein, 10 aa, Artificial Sequence
  Synthetic: Clone: 14;VL FR4
FGGGTKVEIK

SEQ ID NO: 4017 - DNA, 321 bp, Artificial Sequence; identical to SEQ ID NO: 17
  Synthetic: Clone: 14;VL DNA

SEQ ID NO: 4018 - protein, 107 aa, Artificial Sequence; identical to SEQ ID NO: 18
  Synthetic: Clone: 14;VL Protein

SEQ ID NO: 4019-5000 - skipped (982 entries)

SEQ ID NO: 5001 - protein, 9 aa, Artificial Sequence
  Synthetic: Clone: 15;VH CDR1
GTFSSYGIS

SEQ ID NO: 5002 - protein, 17 aa, Artificial Sequence
  Synthetic: Clone: 15;VH CDR2
SIIPQFGTANYAQKFQG

SEQ ID NO: 5003 - protein, 14 aa, Artificial Sequence
  Synthetic: Clone: 15;VH CDR3
AREAGYYRYRYFDL

SEQ ID NO: 5004 - protein, 11 aa, Artificial Sequence
  Synthetic: Clone: 15;VL CDR1
RASQSVSSNLA

SEQ ID NO: 5005 - protein, 7 aa, Artificial Sequence
  Synthetic: Clone: 15;VL CDR2
GASTRAT

SEQ ID NO: 5006 - protein, 9 aa, Artificial Sequence
  Synthetic: Clone: 15;VL CDR3
QQHALWPLT

SEQ ID NO: 5007 - protein, 26 aa, Artificial Sequence
  Synthetic: Clone: 15;VH FR1
QVQLVQSGAEVKKPGSSVKVSCKASG

SEQ ID NO: 5008 - protein, 14 aa, Artificial Sequence
  Synthetic: Clone: 15;VH FR2
WVRQAPGQGLEWMG

SEQ ID NO: 5009 - protein, 30 aa, Artificial Sequence
  Synthetic: Clone: 15;VH FR3
RVTITADESTSTVYMELSSLRSEDTAVYYC

SEQ ID NO: 5010 - protein, 11 aa, Artificial Sequence
  Synthetic: Clone: 15;VH FR4
WGRGTLVTVSS

SEQ ID NO: 5011 - DNA, 363 bp, Artificial Sequence
  Synthetic: Clone: 15;VH DNA
caggtgcagctggtgcagtctggggctgaggtgaagaagcctgggtcctcggtgaaggtctcctgcaaggcttctggaggcaccttctcgagctatggtatcagctgggtgcgacaggcccctggacaagggcttgagtggatgggatcgatcatccctcagtttggtacagcaaactacgcacagaagttccagggcagagtcacgattaccgcggacgaatccacgagcacagtctacatggagctgagcagcctgagatctgaggacacggcggtgtactactgcgccagagaagccggatactaccgctaccgatacttcgacctatgggggagaggtaccttggtcaccgtctcctca

SEQ ID NO: 5012 - protein, 121 aa, Artificial Sequence
  Synthetic: Clone: 15;VH Protein
QVQLVQSGAEVKKPGSSVKVSCKASGGTFSSYGISWVRQAPGQGLEWMGSIIPQFGTANYAQKFQGRVTITADESTSTVYMELSSLRSEDTAVYYCAREAGYYRYRYFDLWGRGTLVTVSS

SEQ ID NO: 5013 - protein, 23 aa, Artificial Sequence
  Synthetic: Clone: 15;VL FR1
EIVMTQSPATLSVSPGERATLSC

SEQ ID NO: 5014 - protein, 15 aa, Artificial Sequence
  Synthetic: Clone: 15;VL FR2
WYQQKPGQAPRLLIY

SEQ ID NO: 5015 - protein, 32 aa, Artificial Sequence; identical to SEQ ID NO: 15
  Synthetic: Clone: 15;VL FR3

SEQ ID NO: 5016 - protein, 10 aa, Artificial Sequence
  Synthetic: Clone: 15;VL FR4
FGGGTKVEIK

SEQ ID NO: 5017 - DNA, 321 bp, Artificial Sequence; identical to SEQ ID NO: 17
  Synthetic: Clone: 15;VL DNA

SEQ ID NO: 5018 - protein, 107 aa, Artificial Sequence; identical to SEQ ID NO: 18
  Synthetic: Clone: 15;VL Protein

SEQ ID NO: 5019-6000 - skipped (982 entries)

SEQ ID NO: 6001 - protein, 9 aa, Artificial Sequence
  Synthetic: Clone: 16;VH CDR1
GTFSSNAIG

SEQ ID NO: 6002 - protein, 17 aa, Artificial Sequence
  Synthetic: Clone: 16;VH CDR2
GIIPAFGTANYAQKFQG

SEQ ID NO: 6003 - protein, 12 aa, Artificial Sequence
  Synthetic: Clone: 16;VH CDR3
ARDPVRRSPFDI

SEQ ID NO: 6004 - protein, 11 aa, Artificial Sequence
  Synthetic: Clone: 16;VL CDR1
RASQSVSSYLA

SEQ ID NO: 6005 - protein, 7 aa, Artificial Sequence
  Synthetic: Clone: 16;VL CDR2
DSSNRAT

SEQ ID NO: 6006 - protein, 9 aa, Artificial Sequence
  Synthetic: Clone: 16;VL CDR3
QQSFLWPRT

SEQ ID NO: 6007 - protein, 26 aa, Artificial Sequence
  Synthetic: Clone: 16;VH FR1
QVQLVQSGAEVKKPGSSVKVSCKASG

SEQ ID NO: 6008 - protein, 14 aa, Artificial Sequence
  Synthetic: Clone: 16;VH FR2
WVRQAPGQGLEWMG

SEQ ID NO: 6009 - protein, 30 aa, Artificial Sequence; identical to SEQ ID NO: 9
  Synthetic: Clone: 16;VH FR3

SEQ ID NO: 6010 - protein, 11 aa, Artificial Sequence
  Synthetic: Clone: 16;VH FR4
WGQGTMVTVSS

SEQ ID NO: 6011 - DNA, 357 bp, Artificial Sequence
  Synthetic: Clone: 16;VH DNA
caggtgcagctggtgcagtctggggctgaggtgaagaagcctgggtcctcggtgaaggtctcctgcaaggcttctggaggcaccttcagcagcaatgctatcgggtgggtgcgacaggcccctggacaagggcttgagtggatgggagggatcattcctgcttttggtacagcaaactacgcacagaagttccagggcagagtcacgattaccgcggacgaatccacgagcacagcctacatggagctgagcagcctgagatctgaggacacggcggtgtactactgcgccagagatccggtgagaagaagcccattcgacatatggggtcagggtacaatggtcaccgtctcctca

SEQ ID NO: 6012 - protein, 119 aa, Artificial Sequence
  Synthetic: Clone: 16;VH Protein
QVQLVQSGAEVKKPGSSVKVSCKASGGTFSSNAIGWVRQAPGQGLEWMGGIIPAFGTANYAQKFQGRVTITADESTSTAYMELSSLRSEDTAVYYCARDPVRRSPFDIWGQGTMVTVSS

SEQ ID NO: 6013 - protein, 23 aa, Artificial Sequence
  Synthetic: Clone: 16;VL FR1
EIVLTQSPATLSLSPGERATLSC

SEQ ID NO: 6014 - protein, 15 aa, Artificial Sequence
  Synthetic: Clone: 16;VL FR2
WYQQKPGQAPRLLIY

SEQ ID NO: 6015 - protein, 32 aa, Artificial Sequence; identical to SEQ ID NO: 115
  Synthetic: Clone: 16;VL FR3

SEQ ID NO: 6016 - protein, 10 aa, Artificial Sequence
  Synthetic: Clone: 16;VL FR4
FGGGTKVEIK

SEQ ID NO: 6017 - DNA, 321 bp, Artificial Sequence; identical to SEQ ID NO: 117
  Synthetic: Clone: 16;VL DNA

SEQ ID NO: 6018 - protein, 107 aa, Artificial Sequence; identical to SEQ ID NO: 118
  Synthetic: Clone: 16;VL Protein

SEQ ID NO: 6019-7000 - skipped (982 entries)

SEQ ID NO: 7001 - protein, 9 aa, Artificial Sequence
  Synthetic: Clone: 17;VH CDR1
GTFSGYAIH

SEQ ID NO: 7002 - protein, 17 aa, Artificial Sequence
  Synthetic: Clone: 17;VH CDR2
GIMPIFGTAAYAQKFQG

SEQ ID NO: 7003 - protein, 17 aa, Artificial Sequence
  Synthetic: Clone: 17;VH CDR3
ARPRGDYSGYDAGPIDY

SEQ ID NO: 7004 - protein, 11 aa, Artificial Sequence
  Synthetic: Clone: 17;VL CDR1
RASQSVSSYLA

SEQ ID NO: 7005 - protein, 7 aa, Artificial Sequence
  Synthetic: Clone: 17;VL CDR2
DASNRAT

SEQ ID NO: 7006 - protein, 9 aa, Artificial Sequence
  Synthetic: Clone: 17;VL CDR3
QQRFHFPPT

SEQ ID NO: 7007 - protein, 26 aa, Artificial Sequence
  Synthetic: Clone: 17;VH FR1
QVQLVQSGAEVKKPGSSVKVSCKASG

SEQ ID NO: 7008 - protein, 14 aa, Artificial Sequence
  Synthetic: Clone: 17;VH FR2
WVRQAPGQGLEWMG

SEQ ID NO: 7009 - protein, 30 aa, Artificial Sequence; identical to SEQ ID NO: 9
  Synthetic: Clone: 17;VH FR3

SEQ ID NO: 7010 - protein, 11 aa, Artificial Sequence
  Synthetic: Clone: 17;VH FR4
WGQGTLVTVSS

SEQ ID NO: 7011 - DNA, 372 bp, Artificial Sequence
  Synthetic: Clone: 17;VH DNA
caggtgcagctggtgcagtctggggctgaggtgaagaagcctgggtcctcggtgaaggtctcctgcaaggcttctggaggcaccttcagcgggtatgctatccattgggtgcgacaggcccctggacaagggcttgagtggatgggagggatcatgcctatctttggtacagcagcgtacgcacagaagttccagggcagagtcacgattaccgcggacgaatccacgagcacagcctacatggagctgagcagcctgagatctgaggacacggcggtgtactactgcgccagacccagaggcgactacagcggatacgacgcaggtcccattgactactggggacagggtacattggtcaccgtctcctca

SEQ ID NO: 7012 - protein, 124 aa, Artificial Sequence
  Synthetic: Clone: 17;VH Protein
QVQLVQSGAEVKKPGSSVKVSCKASGGTFSGYAIHWVRQAPGQGLEWMGGIMPIFGTAAYAQKFQGRVTITADESTSTAYMELSSLRSEDTAVYYCARPRGDYSGYDAGPIDYWGQGTLVTVSS

SEQ ID NO: 7013 - protein, 23 aa, Artificial Sequence
  Synthetic: Clone: 17;VL FR1
EIVLTQSPATLSLSPGERATLSC

SEQ ID NO: 7014 - protein, 15 aa, Artificial Sequence
  Synthetic: Clone: 17;VL FR2
WYQQKPGQAPRLLIY

SEQ ID NO: 7015 - protein, 32 aa, Artificial Sequence; identical to SEQ ID NO: 115
  Synthetic: Clone: 17;VL FR3

SEQ ID NO: 7016 - protein, 10 aa, Artificial Sequence
  Synthetic: Clone: 17;VL FR4
FGGGTKVEIK

SEQ ID NO: 7017 - DNA, 321 bp, Artificial Sequence; identical to SEQ ID NO: 917
  Synthetic: Clone: 17;VL DNA

SEQ ID NO: 7018 - protein, 107 aa, Artificial Sequence; identical to SEQ ID NO: 918
  Synthetic: Clone: 17;VL Protein

SEQ ID NO: 7019-8000 - skipped (982 entries)

SEQ ID NO: 8001 - protein, 11 aa, Artificial Sequence
  Synthetic: Clone: 18;VH CDR1
GSISSGGSYWS

SEQ ID NO: 8002 - protein, 16 aa, Artificial Sequence
  Synthetic: Clone: 18;VH CDR2
AIYYDGSTYYNPSLKS

SEQ ID NO: 8003 - protein, 12 aa, Artificial Sequence
  Synthetic: Clone: 18;VH CDR3
ARGSPTYHDFDL

SEQ ID NO: 8004 - protein, 11 aa, Artificial Sequence
  Synthetic: Clone: 18;VL CDR1
RASQSVSSYLA

SEQ ID NO: 8005 - protein, 7 aa, Artificial Sequence
  Synthetic: Clone: 18;VL CDR2
DASNRAT

SEQ ID NO: 8006 - protein, 9 aa, Artificial Sequence
  Synthetic: Clone: 18;VL CDR3
QQRAIWPPT

SEQ ID NO: 8007 - protein, 26 aa, Artificial Sequence
  Synthetic: Clone: 18;VH FR1
QVQLQESGPGLVKPSQTLSLTCTVSG

SEQ ID NO: 8008 - protein, 14 aa, Artificial Sequence
  Synthetic: Clone: 18;VH FR2
WIRQHPGKGLEWIG

SEQ ID NO: 8009 - protein, 30 aa, Artificial Sequence; identical to SEQ ID NO: 609
  Synthetic: Clone: 18;VH FR3

SEQ ID NO: 8010 - protein, 11 aa, Artificial Sequence
  Synthetic: Clone: 18;VH FR4
WGRGTLVTVSS

SEQ ID NO: 8011 - DNA, 360 bp, Artificial Sequence
  Synthetic: Clone: 18;VH DNA
caggtgcagctgcaggagtcgggcccaggactggtgaagccttcacagaccctgtccctcacctgtactgtctctggtggctccatcagcagtggtggttcttactggtcttggatccgccagcacccagggaagggcctggagtggattggggcgatctattacgatgggagcacctactacaacccgtccctcaagagtcgagttaccatatcagtagacacgtctaagaaccagttctccctgaagctgagttctgtgaccgccgcagacacggcggtgtactactgcgccagaggttcccctacataccacgacttcgacctatgggggagaggtaccttggtcaccgtctcctca

SEQ ID NO: 8012 - protein, 120 aa, Artificial Sequence
  Synthetic: Clone: 18;VH Protein
QVQLQESGPGLVKPSQTLSLTCTVSGGSISSGGSYWSWIRQHPGKGLEWIGAIYYDGSTYYNPSLKSRVTISVDTSKNQFSLKLSSVTAADTAVYYCARGSPTYHDFDLWGRGTLVTVSS

SEQ ID NO: 8013 - protein, 23 aa, Artificial Sequence
  Synthetic: Clone: 18;VL FR1
EIVLTQSPATLSLSPGERATLSC

SEQ ID NO: 8014 - protein, 15 aa, Artificial Sequence
  Synthetic: Clone: 18;VL FR2
WYQQKPGQAPRLLIY

SEQ ID NO: 8015 - protein, 32 aa, Artificial Sequence; identical to SEQ ID NO: 115
  Synthetic: Clone: 18;VL FR3

SEQ ID NO: 8016 - protein, 10 aa, Artificial Sequence
  Synthetic: Clone: 18;VL FR4
FGGGTKVEIK

SEQ ID NO: 8017 - DNA, 321 bp, Artificial Sequence; identical to SEQ ID NO: 717
  Synthetic: Clone: 18;VL DNA

SEQ ID NO: 8018 - protein, 107 aa, Artificial Sequence; identical to SEQ ID NO: 718
  Synthetic: Clone: 18;VL Protein

SEQ ID NO: 8019-9000 - skipped (982 entries)

SEQ ID NO: 9001 - protein, 9 aa, Artificial Sequence
  Synthetic: Clone: 19;VH CDR1
FTFRSYWMS

SEQ ID NO: 9002 - protein, 17 aa, Artificial Sequence
  Synthetic: Clone: 19;VH CDR2
TIKQDGSEKFYVDSVKG

SEQ ID NO: 9003 - protein, 15 aa, Artificial Sequence
  Synthetic: Clone: 19;VH CDR3
ARDFTRWSHVNWFDP

SEQ ID NO: 9004 - protein, 11 aa, Artificial Sequence
  Synthetic: Clone: 19;VL CDR1
RASQSVSSSLA

SEQ ID NO: 9005 - protein, 7 aa, Artificial Sequence
  Synthetic: Clone: 19;VL CDR2
GASTRAT

SEQ ID NO: 9006 - protein, 9 aa, Artificial Sequence
  Synthetic: Clone: 19;VL CDR3
QQYYHHPYT

SEQ ID NO: 9007 - protein, 26 aa, Artificial Sequence
  Synthetic: Clone: 19;VH FR1
EVQLVESGGGLVQPGGSLRLSCAASG

SEQ ID NO: 9008 - protein, 14 aa, Artificial Sequence
  Synthetic: Clone: 19;VH FR2
WVRQAPGKGLEWVA

SEQ ID NO: 9009 - protein, 30 aa, Artificial Sequence; identical to SEQ ID NO: 509
  Synthetic: Clone: 19;VH FR3

SEQ ID NO: 9010 - protein, 11 aa, Artificial Sequence
  Synthetic: Clone: 19;VH FR4
WGQGTLVTVSS

SEQ ID NO: 9011 - DNA, 366 bp, Artificial Sequence
  Synthetic: Clone: 19;VH DNA
gaggtgcagctggtggagtctgggggaggcttggtccagcctggggggtccctgagactctcctgtgcagcctctggattcacctttcgtagctattggatgagctgggtccgccaggctccagggaaggggctggagtgggtggccacgataaagcaagatggaagtgagaaattttatgtggactctgtgaagggccgattcaccatctccagagacaacgccaagaactcactgtatctgcaaatgaacagcctgagagccgaggacacggcggtgtactactgcgctagggatttcactagatggtcccacgtgaactggtttgatccctggggacagggtacattggtcaccgtctcctca

SEQ ID NO: 9012 - protein, 122 aa, Artificial Sequence
  Synthetic: Clone: 19;VH Protein
EVQLVESGGGLVQPGGSLRLSCAASGFTFRSYWMSWVRQAPGKGLEWVATIKQDGSEKFYVDSVKGRFTISRDNAKNSLYLQMNSLRAEDTAVYYCARDFTRWSHVNWFDPWGQGTLVTVSS

SEQ ID NO: 9013 - protein, 23 aa, Artificial Sequence
  Synthetic: Clone: 19;VL FR1
EIVMTQSPATLSVSPGERATLSC

SEQ ID NO: 9014 - protein, 15 aa, Artificial Sequence
  Synthetic: Clone: 19;VL FR2
WYQQKPGQAPRLLIF

SEQ ID NO: 9015 - protein, 32 aa, Artificial Sequence; identical to SEQ ID NO: 15
  Synthetic: Clone: 19;VL FR3

SEQ ID NO: 9016 - protein, 10 aa, Artificial Sequence
  Synthetic: Clone: 19;VL FR4
FGGGTKVEIK

SEQ ID NO: 9017 - DNA, 321 bp, Artificial Sequence; identical to SEQ ID NO: 517
  Synthetic: Clone: 19;VL DNA

SEQ ID NO: 9018 - protein, 107 aa, Artificial Sequence; identical to SEQ ID NO: 518
  Synthetic: Clone: 19;VL Protein

SEQ ID NO: 9019-10000 - skipped (982 entries)

SEQ ID NO: 10001 - protein, 9 aa, Artificial Sequence
  Synthetic: Clone: 20;VH CDR1
GTFSSYAIS

SEQ ID NO: 10002 - protein, 17 aa, Artificial Sequence
  Synthetic: Clone: 20;VH CDR2
GILPIFGDANYAQKFQG

SEQ ID NO: 10003 - protein, 17 aa, Artificial Sequence
  Synthetic: Clone: 20;VH CDR3
ARPRGDYSGYDAGPIDY

SEQ ID NO: 10004 - protein, 11 aa, Artificial Sequence
  Synthetic: Clone: 20;VL CDR1
RASQSVSSYLA

SEQ ID NO: 10005 - protein, 7 aa, Artificial Sequence
  Synthetic: Clone: 20;VL CDR2
DSSNRAT

SEQ ID NO: 10006 - protein, 9 aa, Artificial Sequence
  Synthetic: Clone: 20;VL CDR3
QQRYLFPIT

SEQ ID NO: 10007 - protein, 26 aa, Artificial Sequence
  Synthetic: Clone: 20;VH FR1
QVQLVQSGAEVKKPGSSVKVSCKASG

SEQ ID NO: 10008 - protein, 14 aa, Artificial Sequence
  Synthetic: Clone: 20;VH FR2
WVRQAPGQGLEWMG

SEQ ID NO: 10009 - protein, 30 aa, Artificial Sequence; identical to SEQ ID NO: 9
  Synthetic: Clone: 20;VH FR3

SEQ ID NO: 10010 - protein, 11 aa, Artificial Sequence
  Synthetic: Clone: 20;VH FR4
WGQGTLVTVSS

SEQ ID NO: 10011 - DNA, 372 bp, Artificial Sequence
  Synthetic: Clone: 20;VH DNA
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcttgcctatctttggtgatgcaaactacgcacagaagttccagggcagagtcacgattaccgcggacgaatccacgagcacagcctacatggagctgagcagcctgagatctgaggacacggcggtgtactactgcgccagacccagaggcgactacagcggatacgacgcaggtcccattgactactggggacagggtacattggtcaccgtctcctca

SEQ ID NO: 10012 - protein, 124 aa, Artificial Sequence
  Synthetic: Clone: 20;VH Protein
QVQLVQSGAEVKKPGSSVKVSCKASGGTFSSYAISWVRQAPGQGLEWMGGILPIFGDANYAQKFQGRVTITADESTSTAYMELSSLRSEDTAVYYCARPRGDYSGYDAGPIDYWGQGTLVTVSS

SEQ ID NO: 10013 - protein, 23 aa, Artificial Sequence
  Synthetic: Clone: 20;VL FR1
EIVMTQSPATLSLSPGERATLSC

SEQ ID NO: 10014 - protein, 15 aa, Artificial Sequence
  Synthetic: Clone: 20;VL FR2
WYQQKPGQAPRLLIY

SEQ ID NO: 10015 - protein, 32 aa, Artificial Sequence; identical to SEQ ID NO: 115
  Synthetic: Clone: 20;VL FR3

SEQ ID NO: 10016 - protein, 10 aa, Artificial Sequence
  Synthetic: Clone: 20;VL FR4
FGGGTKVEIK

SEQ ID NO: 10017 - DNA, 321 bp, Artificial Sequence; identical to SEQ ID NO: 1017
  Synthetic: Clone: 20;VL DNA

SEQ ID NO: 10018 - protein, 107 aa, Artificial Sequence; identical to SEQ ID NO: 1018
  Synthetic: Clone: 20;VL Protein

SEQ ID NO: 10019-20000 - skipped (9982 entries)

SEQ ID NO: 20001 - protein, 9 aa, Artificial Sequence
  Synthetic: Clone: 21;VH CDR1
GTFSSEGIS

SEQ ID NO: 20002 - protein, 17 aa, Artificial Sequence
  Synthetic: Clone: 21;VH CDR2
SILPIFGTANYAQKFQG

SEQ ID NO: 20003 - protein, 14 aa, Artificial Sequence
  Synthetic: Clone: 21;VH CDR3
AREAGYYRYRYFDL

SEQ ID NO: 20004 - protein, 11 aa, Artificial Sequence
  Synthetic: Clone: 21;VL CDR1
RASQSVSSNLA

SEQ ID NO: 20005 - protein, 7 aa, Artificial Sequence
  Synthetic: Clone: 21;VL CDR2
GASTRAT

SEQ ID NO: 20006 - protein, 9 aa, Artificial Sequence
  Synthetic: Clone: 21;VL CDR3
QQHALWPLT

SEQ ID NO: 20007 - protein, 26 aa, Artificial Sequence
  Synthetic: Clone: 21;VH FR1
QVQLVQSGAEVKKPGSSVKVSCKASG

SEQ ID NO: 20008 - protein, 14 aa, Artificial Sequence
  Synthetic: Clone: 21;VH FR2
WVRQAPGQGLEWMG

SEQ ID NO: 20009 - protein, 30 aa, Artificial Sequence; identical to SEQ ID NO: 9
  Synthetic: Clone: 21;VH FR3

SEQ ID NO: 20010 - protein, 11 aa, Artificial Sequence
  Synthetic: Clone: 21;VH FR4
WGKGTLVTVSS

SEQ ID NO: 20011 - DNA, 363 bp, Artificial Sequence
  Synthetic: Clone: 21;VH DNA
caggtgcagctggtgcagtctggggctgaggtgaagaagcctgggtcctcggtgaaggtctcctgcaaggcttctggaggcaccttcagcagcgagggtatcagctgggtgcgacaggcccctggacaagggcttgagtggatgggaagtatcttgcctatctttggtacagcaaactacgcacagaagttccagggcagagtcacgattaccgcggacgaatccacgagcacagcctacatggagctgagcagcctgagatctgaggacacggcggtgtactactgcgccagagaagccggatactaccgctaccgatacttcgacctatgggggaaaggtaccttggtcaccgtctcctca

SEQ ID NO: 20012 - protein, 121 aa, Artificial Sequence
  Synthetic: Clone: 21;VH Protein
QVQLVQSGAEVKKPGSSVKVSCKASGGTFSSEGISWVRQAPGQGLEWMGSILPIFGTANYAQKFQGRVTITADESTSTAYMELSSLRSEDTAVYYCAREAGYYRYRYFDLWGKGTLVTVSS

SEQ ID NO: 20013 - protein, 23 aa, Artificial Sequence
  Synthetic: Clone: 21;VL FR1
EIVMTQSPATLSVSPGERATLSC

SEQ ID NO: 20014 - protein, 15 aa, Artificial Sequence
  Synthetic: Clone: 21;VL FR2
WYQQKPGQAPRLLIY

SEQ ID NO: 20015 - protein, 32 aa, Artificial Sequence; identical to SEQ ID NO: 15
  Synthetic: Clone: 21;VL FR3

SEQ ID NO: 20016 - protein, 10 aa, Artificial Sequence
  Synthetic: Clone: 21;VL FR4
FGGGTKVEIK

SEQ ID NO: 20017 - DNA, 321 bp, Artificial Sequence; identical to SEQ ID NO: 17
  Synthetic: Clone: 21;VL DNA

SEQ ID NO: 20018 - protein, 107 aa, Artificial Sequence; identical to SEQ ID NO: 18
  Synthetic: Clone: 21;VL Protein

SEQ ID NO: 20019 - protein, 447 aa, Artificial Sequence
  Synthetic: Clone: 21;Heavy Chain Protein
QVQLVQSGAEVKKPGSSVKVSCKASGGTFSSEGISWVRQAPGQGLEWMGSILPIFGTANYAQKFQGRVTITADESTSTAYMELSSLRSEDTAVYYCAREAGYYRYRYFDLWGKGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 20020 - DNA, 1341 bp, Artificial Sequence
  Synthetic: Clone: 21;Heavy Chain DNA
caggtgcagctggtgcagtctggggctgaggtgaagaagcctgggtcctcggtgaaggtctcctgcaaggcttctggaggcaccttcagcagcgagggtatcagctgggtgcgacaggcccctggacaagggcttgagtggatgggaagtatcttgcctatctttggtacagcaaactacgcacagaagttccagggcagagtcacgattaccgcggacgaatccacgagcacagcctacatggagctgagcagcctgagatctgaggacacggcggtgtactactgcgccagagaagccggatactaccgctaccgatacttcgacctatgggggaaaggtaccttggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgccctccttgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 20021 - protein, 214 aa, Artificial Sequence
  Synthetic: Clone: 21;Light Chain Protein
EIVMTQSPATLSVSPGERATLSCRASQSVSSNLAWYQQKPGQAPRLLIYGASTRATGIPARFSGSGSGTEFTLTISSLQSEDFAVYYCQQHALWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20022 - DNA, 642 bp, Artificial Sequence
  Synthetic: Clone: 21;Light Chain DNA
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagcacgccctctggcctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 20023-30000 - skipped (9978 entries)

SEQ ID NO: 30001 - protein, 9 aa, Artificial Sequence
  Synthetic: Clone: 22;VH CDR1
GTFSSEGIS

SEQ ID NO: 30002 - protein, 17 aa, Artificial Sequence
  Synthetic: Clone: 22;VH CDR2
SILPIFGTANYAQKFQG

SEQ ID NO: 30003 - protein, 14 aa, Artificial Sequence
  Synthetic: Clone: 22;VH CDR3
AREAGYYRYRYFDL

SEQ ID NO: 30004 - protein, 11 aa, Artificial Sequence
  Synthetic: Clone: 22;VL CDR1
RASQSVSSNLA

SEQ ID NO: 30005 - protein, 7 aa, Artificial Sequence
  Synthetic: Clone: 22;VL CDR2
GASTRAT

SEQ ID NO: 30006 - protein, 9 aa, Artificial Sequence
  Synthetic: Clone: 22;VL CDR3
QQHALWPLT

SEQ ID NO: 30007 - protein, 26 aa, Artificial Sequence
  Synthetic: Clone: 22;VH FR1
QVQLVQSGAEVKKPGSSVKVSCKASG

SEQ ID NO: 30008 - protein, 14 aa, Artificial Sequence
  Synthetic: Clone: 22;VH FR2
WVRQAPGQGLEWMG

SEQ ID NO: 30009 - protein, 30 aa, Artificial Sequence; identical to SEQ ID NO: 9
  Synthetic: Clone: 22;VH FR3

SEQ ID NO: 30010 - protein, 11 aa, Artificial Sequence
  Synthetic: Clone: 22;VH FR4
WGRGTLVTVSS

SEQ ID NO: 30011 - DNA, 364 bp, Artificial Sequence
  Synthetic: Clone: 22;VH DNA
caagtgcagttggtgcagtccggagccgaagtcaagaagcccgggtcgagcgtgaaagtgtcctgcaaggcttctggtggaaccttctcaagcgaagggatcagctgggtcagacaggcgccgggccagggtctggagtggatgggttccattctcccgatcttcggaaccgccaattacgcccagaagttccagggtcgcgtgaccatcaccgccgacgaaagcacctcgacggcctatatggaattgtcgtccctgcggtcggaagatacagcggtgtactactgtgcgcgggaagccgggtactaccgctaccgctacttcgatctgtggggaaggggaactctcgtgactgtgtcgagcg

SEQ ID NO: 30012 - protein, 121 aa, Artificial Sequence
  Synthetic: Clone: 22;VH Protein
QVQLVQSGAEVKKPGSSVKVSCKASGGTFSSEGISWVRQAPGQGLEWMGSILPIFGTANYAQKFQGRVTITADESTSTAYMELSSLRSEDTAVYYCAREAGYYRYRYFDLWGRGTLVTVSS

SEQ ID NO: 30013 - protein, 23 aa, Artificial Sequence
  Synthetic: Clone: 22;VL FR1
EIVMTQSPATLSVSPGERATLSC

SEQ ID NO: 30014 - protein, 15 aa, Artificial Sequence
  Synthetic: Clone: 22;VL FR2
WYQQKPGQAPRLLIY

SEQ ID NO: 30015 - protein, 32 aa, Artificial Sequence; identical to SEQ ID NO: 15
  Synthetic: Clone: 22;VL FR3

SEQ ID NO: 30016 - protein, 10 aa, Artificial Sequence
  Synthetic: Clone: 22;VL FR4
FGGGTKVEIK

SEQ ID NO: 30017 - DNA, 321 bp, Artificial Sequence; identical to SEQ ID NO: 17
  Synthetic: Clone: 22;VL DNA

SEQ ID NO: 30018 - protein, 107 aa, Artificial Sequence; identical to SEQ ID NO: 18
  Synthetic: Clone: 22;VL Protein

SEQ ID NO: 30019 - protein, 447 aa, Artificial Sequence
  Synthetic: Clone: 22;Heavy Chain Protein
QVQLVQSGAEVKKPGSSVKVSCKASGGTFSSEGISWVRQAPGQGLEWMGSILPIFGTANYAQKFQGRVTITADESTSTAYMELSSLRSEDTAVYYCAREAGYYRYRYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 30020 - DNA, 1341 bp, Artificial Sequence
  Synthetic: Clone: 22;Heavy Chain DNA
caagtgcagttggtgcagtccggagccgaagtcaagaagcccgggtcgagcgtgaaagtgtcctgcaaggcttctggtggaaccttctcaagcgaagggatcagctgggtcagacaggcgccgggccagggtctggagtggatgggttccattctcccgatcttcggaaccgccaattacgcccagaagttccagggtcgcgtgaccatcaccgccgacgaaagcacctcgacggcctatatggaattgtcgtccctgcggtcggaagatacagcggtgtactactgtgcgcgggaagccgggtactaccgctaccgctacttcgatctgtggggaaggggaactctcgtgactgtgtcgagcgccagcaccaagggacccagcgtgttcccgctggccccttgttcacgatccacttccgaaagcaccgctgcccttggctgccttgtcaaggactacttccctgagcccgtcactgtgtcgtggaacagcggagctctgacctccggcgtccacaccttcccggctgtgctccagtcctccggcctgtactcactgtcctcggtggtcaccgtgccctcctcctccctcggtaccaagacttatacctgcaacgtggaccacaagccctccaacaccaaagtggataagagagtggagagcaaatacggacctccctgccctccttgccctgcgcctgagtttctgggcggaccatccgtctttctgttcccaccgaagcccaaggacaccctcatgatctcccggacccccgaagtgacctgtgtggtggtggacgtgtcacaggaggaccctgaagtgcagtttaattggtacgtcgacggcgtggaagtgcataacgcaaagaccaagccgcgggaggaacagttcaactcaacctaccgcgtggtgtccgtgctgactgtgctgcaccaggactggctgaacggaaaggagtataagtgcaaagtctccaacaagggactgccgagcagcatcgagaaaaccatttcaaaagccaagggccagccgagagagccccaagtgtacactctgccgccgagccaagaggaaatgaccaagaaccaagtgtccctcacttgcctggtcaagggcttctacccgtcggacatcgccgtggagtgggaaagcaacggccagccggaaaacaactacaagactacccctcccgtcctcgactccgacgggtccttcttcctctactcccggctgactgtggataagtcacggtggcaggagggaaacgtgttctcgtgctccgtgatgcacgaagccctgcacaaccactacacgcagaagtccctgtccttgtccctgggg

SEQ ID NO: 30021 - protein, 214 aa, Artificial Sequence; identical to SEQ ID NO: 20021
  Synthetic: Clone: 22;Light Chain Protein

SEQ ID NO: 30022 - DNA, 642 bp, Artificial Sequence; identical to SEQ ID NO: 20022
  Synthetic: Clone: 22;Light Chain DNA

SEQ ID NO: 30023 - DNA, 1431 bp, Artificial Sequence
  Synthetic: Clone: 22;Heavy Chain DNA
gatatcgccaccatggcctctccagctcagctgctgtttctgctgctgctgtggctgcctgacggcgtgcacgcacaagtgcagttggtgcagtccggagccgaagtcaagaagcccgggtcgagcgtgaaagtgtcctgcaaggcttctggtggaaccttctcaagcgaagggatcagctgggtcagacaggcgccgggccagggtctggagtggatgggttccattctcccgatcttcggaaccgccaattacgcccagaagttccagggtcgcgtgaccatcaccgccgacgaaagcacctcgacggcctatatggaattgtcgtccctgcggtcggaagatacagcggtgtactactgtgcgcgggaagccgggtactaccgctaccgctacttcgatctgtggggaaggggaactctcgtgactgtgtcgagcgccagcaccaagggacccagcgtgttcccgctggccccttgttcacgatccacttccgaaagcaccgctgcccttggctgccttgtcaaggactacttccctgagcccgtcactgtgtcgtggaacagcggagctctgacctccggcgtccacaccttcccggctgtgctccagtcctccggcctgtactcactgtcctcggtggtcaccgtgccctcctcctccctcggtaccaagacttatacctgcaacgtggaccacaagccctccaacaccaaagtggataagagagtggagagcaaatacggacctccctgccctccttgccctgcgcctgagtttctgggcggaccatccgtctttctgttcccaccgaagcccaaggacaccctcatgatctcccggacccccgaagtgacctgtgtggtggtggacgtgtcacaggaggaccctgaagtgcagtttaattggtacgtcgacggcgtggaagtgcataacgcaaagaccaagccgcgggaggaacagttcaactcaacctaccgcgtggtgtccgtgctgactgtgctgcaccaggactggctgaacggaaaggagtataagtgcaaagtctccaacaagggactgccgagcagcatcgagaaaaccatttcaaaagccaagggccagccgagagagccccaagtgtacactctgccgccgagccaagaggaaatgaccaagaaccaagtgtccctcacttgcctggtcaagggcttctacccgtcggacatcgccgtggagtgggaaagcaacggccagccggaaaacaactacaagactacccctcccgtcctcgactccgacgggtccttcttcctctactcccggctgactgtggataagtcacggtggcaggagggaaacgtgttctcgtgctccgtgatgcacgaagccctgcacaaccactacacgcagaagtccctgtccttgtccctggggaagtaatgagatatc

SEQ ID NO: 30024-39999 - skipped (9976 entries)

SEQ ID NO: 40000 - protein, 330 aa, Homo sapiens [sequence omitted]

SEQ ID NO: 40001 - protein, 326 aa, Homo sapiens
  misc_feature (1)..( 326): Human IgG4 Constant Region (terminal K absent)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 40002 - protein, 326 aa, Homo sapiens
  misc_feature (1)..( 326): Human IgG4 Constant Region (S228P) (terminal K absent)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 40003 - protein, 326 aa, Homo sapiens
  misc_feature (1)..( 326): Human IgG4 Constant Region (S228P) (L235E) (terminal K absent)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 40004 - protein, 452 aa, Artificial Sequence
  Synthetic: Anti-CD47 heavy chain
QVQLQESGPGLVKPSGTLSLTCAVSGVSIRSINWWNWVRQPPGKGLEWIGEIYHSGSTNYNPSLKSRVTISVDKSKNQFSLKLNSVTAADTAVYYCARDGGIAVTDYYYYGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 40005 - protein, 212 aa, Artificial Sequence
  Synthetic: Anti-CD47 light chain
EIVLTQSPATLSLSPGERATLSCRASESVSSNLAWYQQKPGQAPRLLIYGAFNRATGIPARFSGSGSGTDFTLTISSLEPEDFAVYYCQQRSDWFTFGGGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40006 - protein, 6 aa, Artificial Sequence
  Synthetic: Anti-CD47 VH CDR1
SINWWN

SEQ ID NO: 40007 - protein, 16 aa, Artificial Sequence
  Synthetic: Anti-CD47 VH CDR2
EIYHSGSTNYNPSLKS

SEQ ID NO: 40008 - protein, 16 aa, Artificial Sequence
  Synthetic: Anti-CD47 VH CDR3
DGGIAVTDYYYYGLDV

SEQ ID NO: 40009 - protein, 11 aa, Artificial Sequence
  Synthetic: Anti-CD47 VL CDR1
RASESVSSNLA

SEQ ID NO: 40010 - protein, 7 aa, Artificial Sequence
  Synthetic: Anti-CD47 VL CDR2
GAFNRAT

SEQ ID NO: 40011 - protein, 8 aa, Artificial Sequence
  Synthetic: Anti-CD47 VL CDR3
QQRSDWFT

What is claimed is:

1. An isolated antibody comprising a heavy chain variable region (VH) and a light chain variable region (VL), wherein:
  a. the VH comprises the amino acid sequence of SEQ ID NO: 12 and the VL comprises the amino acid sequence of SEQ ID NO: 18; or
  b. the VH comprises the amino acid sequence of SEQ ID NO: 112 and the VL comprises the amino acid sequence of SEQ ID NO: 118; or
  c. the VH comprises the amino acid sequence of SEQ ID NO: 212 and the VL comprises the amino acid sequence of SEQ ID NO: 218; or
  d. the VH comprises the amino acid sequence of SEQ ID NO: 312 and the VL comprises the amino acid sequence of SEQ ID NO: 318; or
  e. the VH comprises the amino acid sequence of SEQ ID NO: 412 and the VL comprises the amino acid sequence of SEQ ID NO: 418; or f. the VH comprises the amino acid sequence of SEQ ID NO: 512 and the VL comprises the amino acid sequence of SEQ ID NO: 518; or
g. the VH comprises the amino acid sequence of SEQ ID NO: 612 and the VL comprises the amino acid sequence of SEQ ID NO: 618; or
h. the VH comprises the amino acid sequence of SEQ ID NO: 712 and the VL comprises the amino acid sequence of SEQ ID NO: 718; or
i. the VH comprises the amino acid sequence of SEQ ID NO: 812 and the VL comprises the amino acid sequence of SEQ ID NO: 818; or
j. the VH comprises the amino acid sequence of SEQ ID NO: 912 and the VL comprises the amino acid sequence of SEQ ID NO: 918; or
k. the VH comprises the amino acid sequence of SEQ ID NO: 1012 and the VL comprises the amino acid sequence of SEQ ID NO: 1018; or
l. the VH comprises the amino acid sequence of SEQ ID NO: 2012 and the VL comprises the amino acid sequence of SEQ ID NO: 2018; or
m. the VH comprises the amino acid sequence of SEQ ID NO: 3012 and the VL comprises the amino acid sequence of SEQ ID NO: 3018; or
n. the VH comprises the amino acid sequence of SEQ ID NO: 4012 and the VL comprises the amino acid sequence of SEQ ID NO: 4018; or
o. the VH comprises the amino acid sequence of SEQ ID NO: 5012 and the VL comprises the amino acid sequence of SEQ ID NO: 5018; or
p. the VH comprises the amino acid sequence of SEQ ID NO: 6012 and the VL comprises the amino acid sequence of SEQ ID NO: 6018; or
q. the VH comprises the amino acid sequence of SEQ ID NO: 7012 and the VL comprises the amino acid sequence of SEQ ID NO: 7018; or
r. the VH comprises the amino acid sequence of SEQ ID NO: 8012 and the VL comprises the amino acid sequence of SEQ ID NO: 8018; or
s. the VH comprises the amino acid sequence of SEQ ID NO: 9012 and the VL comprises the amino acid sequence of SEQ ID NO: 9018; or
t. the VH comprises the amino acid sequence of SEQ ID NO: 10012 and the VL comprises the amino acid sequence of SEQ ID NO: 10018; or
v. the VH comprises the amino acid sequence of SEQ ID NO: 30012 and the VL comprises the amino acid sequence of SEQ ID NO: 30018.

2. The isolated antibody of claim 1, wherein the antibody is a monoclonal antibody.

3. The isolated antibody of claim 1, wherein the antibody is an antibody fragment, wherein the antibody fragment binds CD39.

4. The isolated antibody of claim 1, wherein the Fc region of the antibody comprises IgG1, IgG2, IgG3, or IgG4.

5. The isolated antibody of claim 1, comprising the heavy chain constant region of SEQ ID NO: 40002.

6. The isolated antibody of claim 1, comprising the heavy chain constant region of SEQ ID NO: 40003.

7. An isolated antibody comprising the light chain variable region of SEQ ID NO: 30018 and the heavy chain variable region of SEQ ID NO: 30012.

8. The isolated antibody of claim 7, comprising a human kappa light chain and the heavy chain constant region of SEQ ID NO: 40002.

9. A composition comprising the antibody of claim 7 and a pharmaceutically acceptable carrier.

10. A method of treating cancer in a subject comprising administering the antibody of claim 7 to a subject having cancer.

11. The method of claim 10, wherein the cancer is an advanced solid tumor.

12. The method of claim 10, wherein the cancer is carcinoma, lymphoma, blastoma, sarcoma, leukemia, pancreatic cancer, gastric cancer, prostate cancer, colorectal cancer, or ovarian cancer, squamous cell cancer, small-cell lung cancer, pituitary cancer, esophageal cancer, astrocytoma, soft tissue sarcoma, non-small cell lung cancer (including squamous cell non-small cell lung cancer), adenocarcinoma of the lung, squamous carcinoma of the lung, cancer of the peritoneum, hepatocellular cancer, gastrointestinal cancer, glioblastoma, cervical cancer, liver cancer, bladder cancer, hepatoma, breast cancer, colon cancer, endometrial or uterine carcinoma, salivary gland carcinoma, kidney cancer, renal cell carcinoma, liver cancer, vulval cancer, thyroid cancer, hepatic carcinoma, brain cancer, endometrial cancer, testis cancer, cholangiocarcinoma, gallbladder carcinoma, melanoma, or various types of head and neck cancer (including squamous cell carcinoma of the head and neck).

13. The method of claim 10, wherein the method further comprises administering a second therapy, optionally wherein the second therapy is chemotherapy, an antagonist of PD-1, an antagonist of PD-L1, or inhibitors or antagonists of the adenosine axis.

14. A nucleic acid encoding the antibody of claim 7.

15. A host cell comprising the nucleic acid of claim 7.

16. A method of producing the antibody of claim 7 comprising culturing the host cell of claim 15 under conditions wherein the antibody is expressed.

17. A kit comprising the antibody of claim 7.

18. The method of claim 10, wherein the method further comprises administering a triple-combination of cancer therapies.

19. The method of claim 18, wherein the triple combination of cancer therapies comprises the antibody of claim 7, and any two of: a chemotherapeutic agent, an antagonist of PD-1 or an antagonist of PD-L1, and inhibitors or antagonists of the adenosine axis, optionally wherein the agent targeting the adenosine axis is a CD73 inhibitor.

* * * * *